United States Patent 7,745,391 (HUMAN THROMBOSPONDIN POLYPEPTIDE) - sequence listing, part 39

SEQ ID NO: 91603 - DNA, 2123 bp, Homo sapiens
tccagttgtcctgagagtgatgactggctccaccttgatgtggctcacataaattcagaaagtatgatagcagtgtaggtggttagcagcacctcataaggtccttcctagcaaggttaaatactgcagagctaatagattggagtgacttctgacctagtcacatcttaaaggaaaacttttcagtttttactttaaaaggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaag

SEQ ID NO: 91604 - DNA, 2809 bp, Homo sapiens
  misc_feature (1975)..(1975): n is a, c, g, or t
  misc_feature (2764)..(2764): n is a, c, g, or t
tccagttgtcctgagagtgatgactggctccaccttgatgtggctcacataaattcagaaagtatgatagcagtgtaggtggttagcagcacctcataaggtccttcctagcaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgatctttgtgacctgtatcttgtgccaacctcctatctcatcctgtgactaagaatncttaacctcctgggagggcagctcaggaggtgtcagcctcattttacccagccctattcaagatggagtcactctggttccaatgcttctgacagcagtagagataacacagtattcttgcaagagaacagagctcctgatcacctgtgtgcgtcctttgagtggatggcagctgcatctctgcattacagctagttagaatgatgagtccttgctatgcctcaagcactgtttcgagtgtttgatgtctattatctcacttcatcctcaccaggaccccatccgagccttaatttcagttgacagtaactattggatccccaggaatatgtttgcatatttggggagaaaatactattggaggggaacagaaatgctactaagggtctcactgtgtcacccaggctggagtccatcaaagctcactgcagccttaaccttctgtgctcaagggatcctcccacttaagcctcctgagtagctggaactacaggcatatgccaccgagcctggctaatctttgatttttttgtacagattgtgtctccttatgttgctcaggctggactcaaacttctggtctcaagcgatctttccatcttagcttcccaaattgttggaattatggacatgagccagtgtgcttggcctgatttttttttttttttaatgagaaaaacgttccttaagaaaagtttcattgtaagacgaggacttgctatgttgccagtttggtcttgaactcggtctcaagtgattctcctgccttgggttcccaaagcgttgggncggcagatgtcagccaccgcgcctgccttattcttataaactcaa

SEQ ID NO: 91605 - DNA, 948 bp, Homo sapiens
  misc_feature (903)..(903): n is a, c, g, or t
atcagaaatgctgtagcataataaagggagcagatgaatgactgaagccctacagctccactaaagattagagtaaaatctgcacttcaaaagatcctgtattcttgcaagagaacagagctcctgatcacctgtgtgcgtcctttgagtggatggcagctgcatctctgcattacagctagttagaatgatgagtccttgctatgcctcaagcactgtttcgagtgtttgatgtctattatctcacttcatcctcaccaggaccccatccgaggatttgcgacttgagtagcattgacggtggtgatggggagcctggcaagacagcagatgtctacagcaagaggagggaatgggaagctgctctgatggcgtaatcatcaaggttgctgataaaatggccttaatttcagttgacagtaactattggatccccaggaatatgtttgcatatttggggagaaaatactattggaggggaacagaaatgctactaagggtctcactgtgtcacccaggctggagtccatcaaagctcactgcagccttaaccttctgtgctcaagggatcctcccacttaagcctcctgagtagctggaactacaggcatatgccaccgagcctggctaatctttgatttttttgtacagattgtgtctccttatgttgctcaggctggactcaaacttctggtctcaagcgatctttccatcttagcttcccaaattgttggaattatggacatgagccagtgtgcttggcctgatttttttttttttttaatgagaaaaacgttccttaagaaaagtttcattgtaagacgaggacttgctatgttgccagtttggtcttgaactcggtctcaagtgattctcctgccttgggttcccaaagcgttgggncggcagatgtcagccaccgcgcctgccttattcttataaactcaa

SEQ ID NO: 91606 - DNA, 796 bp, Homo sapiens
  misc_feature (751)..(751): n is a, c, g, or t
gactagctggtctaagatgtaatcatgttagcaagaggacaggattactgacattaaaaggccaaaagacagagaggtgaggatcttggttgtattagttacggggctgttataaccactaggatttgcgacttgagtagcattgacggtggtgatggggagcctggcaagacagcagatgtctacagcaagaggagggaatgggaagctgctctgatggcgtaatcatcaaggttgctgataaaatggccttaatttcagttgacagtaactattggatccccaggaatatgtttgcatatttggggagaaaatactattggaggggaacagaaatgctactaagggtctcactgtgtcacccaggctggagtccatcaaagctcactgcagccttaaccttctgtgctcaagggatcctcccacttaagcctcctgagtagctggaactacaggcatatgccaccgagcctggctaatctttgatttttttgtacagattgtgtctccttatgttgctcaggctggactcaaacttctggtctcaagcgatctttccatcttagcttcccaaattgttggaattatggacatgagccagtgtgcttggcctgatttttttttttttttaatgagaaaaacgttccttaagaaaagtttcattgtaagacgaggacttgctatgttgccagtttggtcttgaactcggtctcaagtgattctcctgccttgggttcccaaagcgttgggncggcagatgtcagccaccgcgcctgccttattcttataaactcaa

SEQ ID NO: 91607 - DNA, 2038 bp, Homo sapiens
tccagttgtcctgagagtgatgactggctccaccttgatgtggctcacataaattcagaaagtatgatagcagtgtaggtggttagcagcacctcataaggtccttcctagcaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaag

SEQ ID NO: 91608 - DNA, 494 bp, Homo sapiens
tttttttcctttgcccaggctggagtgcagtggcacaatctcggctcactgcaacgtctgcctcccgggttcaagtgattctcctgcctcagcctcctgagtagctgggattatagacgcacgccaccatgcctagctaatttttgtatttttagtagagacggggtttcaccatgttgatcaggctggtctcgaactcctgacctcgtgatctgcccaccttggcctcccaaagtgctgggattacaggcgtgagccactgcacctggcccaggacgtagacatctttagtggggtattgttctgcccaccacagatactattgcttctggtgttaaataacattttatttgagtagataagaaatatgaccctgtatcttcccaaaagacaaatggagatcattagtaaacaactcagtcacttcatctggcttccctcactatttcttgtcacctgttgtccagctgcttcagctacggaccatagattgg

SEQ ID NO: 91609 - DNA, 1199 bp, Homo sapiens
gtcgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaaggtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctctcttaagactcctggtattaccaacataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggtttttttttttcttatcgacaaggtctcactctgtcgcccaggcagaagcacaaaggtgcagtattggctcattgcagcctcgaactcctgggctcatattttcagggttttttgttttttgttttgtttttttgagacagagtcttgctctgttgcccaggcagtagtgcagtggcgcgatatattttcagtttttaaacgtcagaatttttgtttaaaatgcctttttgggctgggcacagtggcttatgcccataataatcccagcactttgggaggccgaggtgagcagatcacctgaggttaggagtttgagaccagcctggccaacacgatgaaaccccgtctctactaaaaatacaaacaaaattagctgggcatggtggcggacatctgtaatcccagctactcaggaggctgaagcagaagaactgcttgaacctgggaggtggaggttgcagtgagccaagatcgcaccattgcactccatcctgggcgacaaaaatgaaacaccgtctca

SEQ ID NO: 91610 - DNA, 719 bp, Homo sapiens
gtcgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaaggtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctctcttaagactcctggtattaccaacataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggtttttttttttcttatcgacaaaaaatgaaacaccgtctca

SEQ ID NO: 91611 - DNA, 1359 bp, Homo sapiens
gtcgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcaggtgcggacccctgccggccggctgatcctgtcccctatcttccgaccctcaaggcctctcccagggctcacccctgacccgaacctctgccccagactgaacccgggcccaacctccatccgcattggtcggcccgaagactgattcccaccctggaggccccttggaaagatccttatctttgagcctcagttttctcttctggtaaaagggtggttatgatggctgtaataattaaagggtgaagagctaaatacatggcgggttcaaaggttgctattgttatttgtattactattattattagctcaaaccatcacctttgcagtatgcattcgaagtccgttagcccctgtcacctacatggcaaacgtgcagagagagaaacggagatccccattttacagatgaaaaagcttagggagagaagtgatatacctggggccatgcagcttctggcaggattgatggattttaatcactaatgagaggatgtaatctgtatcctatggctttttctcctcactccacagcccacggggtcctaagtaggaaccagcttcacctctctgctttccctcttatgaaaatggccgatgcctttttgtgaaggtctcaaagcccacttcatcctggctgcagcaccaaaaggacaaaggcccgcttttgaagtgcctgataaggcattcctttcacccctccatgaggaaggtggcaaatcttgagactccctattagagagcttcgattttcctgaaattgtgttaggaaaatagggtgacttggtttgatcttggtttctatacctattatggctgcctgactctggtcatttggcccctgcaggcctaagccacttggttttgcttcacatattggggtttattagaacagtacgtagggaagcaatgccagaggcacccgtcccttttccctgccttctaggtgctcctgggaaatcctggttttccatggttaggcaaatgtcagagaattggggaaataaataatgtttttgttagactaacattccatgtatttaaaaaataaaaatattttggtcctcatcctgta

SEQ ID NO: 91612 - DNA, 464 bp, Homo sapiens
tactactactactaaattcgcggccgcgtcgacaagagtcttgctctgttgcccaggcagtagtgcagtggcgcgatatattttcagtttttaaacgtcagaatttttgtttaaaatgcctttttgggctgggcacagtggcttatgcccataataatcccagcactttgggaggccgaggtgagcagatcacctgaggttaggagtttgagaccagcctggccaacacgatgaaaccccgtctctactaaaaatacaaacaaaattagctgggcatggtggcggacatctgtaatcccagctactcaggaggctgaagcagaagaactgcttgaacctgggaggtggaggttgcagtgagccaagatcgcaccattgcactccatcctgggcgacaaaaatgaaacaccgtctcaaaaaaaataaaaataataaaataaaatgcctttttgttgttgatgtaa

SEQ ID NO: 91613 - DNA, 1247 bp, Homo sapiens
gtcgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaaggtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctctcttaagactcctggtattaccaacataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggtttttttttttcttatcgacaaggtctcactctgtcgcccaggcagaagcacaaaggtgcagtattggctcattgcagcctcgaactcctgggctcatattttcagggttttttgttttttgttttgtttttttgagacagagtcttgctctgttgcccaggcagtagtgcagtggcgcgatatattttcagtttttaaacgtcagaatttttgtttaaaatgcctttttgggctgggcacagtggcttatgcccataataatcccagcactttgggaggccgaggtgagcagatcacctgaggttaggagtttgagaccagcctggccaacacgatgaaaccccgtctctactaaaaatacaaacaaaattagctgggcatggtggcggacatctgtaatcccagctactcaggaggctgaagcagaagaactgcttgaacctgggaggtggaggttgcagtgagccaagatcgcaccattgcactccatcctgggcgacaaaaatgaaacaccgtctcaaaaaaaataaaaataataaaataaaatgcctttttgttgttgatgtaa

SEQ ID NO: 91614 - DNA, 767 bp, Homo sapiens
gtcgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaaggtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctctcttaagactcctggtattaccaacataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggtttttttttttcttatcgacaaaaaatgaaacaccgtctcaaaaaaaataaaaataataaaataaaatgcctttttgttgttgatgtaa

SEQ ID NO: 91615 - DNA, 826 bp, Homo sapiens
gtcgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagcccacggggtcctaagtaggaaccagcttcacctctctgctttccctcttatgaaaatggccgatgcctttttgtgaaggtctcaaagcccacttcatcctggctgcagcaccaaaaggacaaaggcccgcttttgaagtgcctgataaggcattcctttcacccctccatgaggaaggtggcaaatcttgagactccctattagagagcttcgattttcctgaaattgtgttaggaaaatagggtgacttggtttgatcttggtttctatacctattatggctgcctgactctggtcatttggcccctgcaggcctaagccacttggttttgcttcacatattggggtttattagaacagtacgtagggaagcaatgccagaggcacccgtcccttttccctgccttctaggtgctcctgggaaatcctggttttccatggttaggcaaatgtcagagaattggggaaataaataatgtttttgttagactaacattccatgtatttaaaaaataaaaatattttggtcctcatcctgta

SEQ ID NO: 91616 - DNA, 1080 bp, Homo sapiens
gtcgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaaggtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctctcttaagactcctggtattaccaacataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggtttttttttttcttatcgacagagtcttgctctgttgcccaggcagtagtgcagtggcgcgatatattttcagtttttaaacgtcagaatttttgtttaaaatgcctttttgggctgggcacagtggcttatgcccataataatcccagcactttgggaggccgaggtgagcagatcacctgaggttaggagtttgagaccagcctggccaacacgatgaaaccccgtctctactaaaaatacaaacaaaattagctgggcatggtggcggacatctgtaatcccagctactcaggaggctgaagcagaagaactgcttgaacctgggaggtggaggttgcagtgagccaagatcgcaccattgcactccatcctgggcgacaaaaatgaaacaccgtctca

SEQ ID NO: 91617 - DNA, 135 bp, Homo sapiens
caccattattcttcctgccacattgcactggggactcctgagccccatgcctaccgggaatggaacaggctggaatggccttaataggctgtggataggactcagatgagatgaaccaagaacttcctgaccgtg

SEQ ID NO: 91618 - DNA, 873 bp, Homo sapiens
attcctgcagaatccctgggcccgctcgccaagtgaatgcgactgtccccctcagccgcccccattcctgccttggccagaccctccaatgccccgagagacccccagaatacgaggttctcctccgcaggaatgagcctcaccctctcatctctcctgttcctttttctcgttgccaaatctctgtctcgtgcccttcaggtcaaggaaatatatccccatccagctctgggccccttaccaggccttcccctcaccacctgcaaagactgaccactaaacctctacaagcgctggatctttgaaaaaggctcccagcccagccctatcaccacttatcaccccaccccatcaccgctgccccacgagatgcatgacccccagcaaggacctctccaggcagctgagctgcccagacgggaagcttcctagagctcgcgtggccatcaggcccctcctgccctgtcttggacccacgctgcctgggaccgaacccttctgtagccaccaaaaccagatcccgtagcccgcaataaaggggcccgggtttctaagccacttgtatttccccattcccccagactctcccagctagagttctgtagaacccggaagcagctcctgcatccccaagactttagatccaagtccctgtccaaaccctcaacctcactgagcttctcagtcatctcagccctctgattagagtcccagcctgccctatgtaatcttatcgccttccctcctgggaagactgccggggacccaagtagaagactggggcctaagggccaggcgcggtggctcatgcctgtaatcccagcactttgggaggccaaggcgggtggatcacttgaggtcaagagttcaaga

SEQ ID NO: 91619 - DNA, 461 bp, Homo sapiens
ccaacacatgtggggcagacggctttttgctgctaagatgtggtttaactagcattgccaaggtgtggagaaaagcgttctgccagcacagttggtagtagcaccctgagctctctgtcttctaggtagcgggggacaggcctgggtgactggcatgaacccagcttctctgttgcaacccccagctggaatctccagtcaccatggatgggagaactgacaggcagggagaaagcatgtcaagactgtgaggaaaggctgtcccctcaaccccaacctgaggtcaccaaagtctccctcctaaagtaaacagaattttccattttgtagggagaattgtgcactactagttgacatcacttgaaccaggatttcctgctagtgagtaggatttggcatccctacttagggagctcgggacaggccagctggggcccaacgggggctggtgctgggtctgt

SEQ ID NO: 91620 - DNA, 747 bp, Homo sapiens
tttgagtagacttttaacgtcacactgctttttttttcttcctttttttcgagacagagtctcactctgtcacccaggctggagtgcagtggtgcaatcttggctcttgggtcactgcaccctccaccttctgggttcaagcaattttcatgcctcagcctcctaagtagctagaattacaggcacatgccaccatgcccacctggctaattttttttttaatagagatgggttttgtcatgttggccaggctgggcttgaactcctgacttcaagtgatctgcccccttggcctcttaaagtgctgggattataggtgtgagccactgcgcccagccacattacttcattcttcaaccttgaaagtcacttgatttattttccttatttattgctacagtttaaataggggcttcattggctccagttgctgcgtttcctaatactaaacaatctgttgggttttaggataccttaacttcatttatttatttatgaatgaatgaatgagatggagtctcgctctagcccaggctggagtgcaatggcacgatcttggctcactacaatctccacctcccgggttcaggagattctccctgtctcagcctcctgagtagctgggattacaggtgcccgccaccatgcccaactgatttttgtatttttagtagagacggggtttcaccatgttggccaggctgttctgcaactcctgacctcaggtgatctgccctcctcggcctc

SEQ ID NO: 91621 - DNA, 502 bp, Homo sapiens
tttgagaccaggttgctgggcagacttggtgtctggcaagggccttcttccgggtttacagacagctgtcttcccacgcatcttcacatggcccagggagaggcagggagagcgtggtgagtgcgtgtgcactctggggtctcttatgaggatgctcgtcccatcatgagggccccacctcaggaccatttcacctcatcacctctgaaggccctgcgtcctcacgccatcccgctggggtcagggcttcagcatcgggtttcgagggacacaaacattcagtccacagcagggttctcgccatcttctgatgtgcctcaaagggtgtgccagtcagaggaccgtgggatgaatcctaacgtaacacccgcgccccggggccgggcatgatggctcacacctgtagtcagaggaccatgggatcccaacgtcacaccagcgccccggggccgggcatgatggctcacacctgtagtcagaggaccgtgggatgaatctttat

SEQ ID NO: 91622 - DNA, 413 bp, Homo sapiens
aacctgaggacgagctgaggaggctgagaggtgataagcgctttgtggtctgatagtaggggtgtgtaacttgttgcctggccccacatttgagccccaagttctgatacagaaactactcctgggaggctgtgtgtttctccttccacacccccagcttggcagtgtttctgggggcctagctgcccctcttggtgccctcgctaccttctccactgcctgccttgcacctgaggtaccttggcctgcctgtggatgcttggtggggacctcaggccaacctactttggctgccttccctgccccattccttgttaaaaaaagaaacagatttcaacaccagcctccgtctgtccccatctgaaaccgttggcaggaaagcagcactgcccgcgtctctttgctccatctca

SEQ ID NO: 91623 - DNA, 896 bp, Homo sapiens
tgatagcatgaaccccgaaaacctgaggcaggtctcagttaacttagaatgtttattttgcccaggttgaggaccggtgcccgtgacacagcctcaggaggtcctgacgagatgtgcccaaggtggtcagaacacactgtagatttatacactctagggagacatgagacatcaatcaacatacgtaagatgaacattggtttggttaagatgagcattggttttgtccagaaaggcaagacaactccaagcaaaggtaggaagactggaagcagggagggggcttccgggtcacgggtagataagagacaaatggtggcattcttttgagtttctgattagcctcttcaaaggaaacaatcagatctgcatttctctcagtgagcagaggggtgactttgaatagaacgggaggcacgttggtgctaagcagttcccagctagacttttccctttagcttagggattttggagccccaggattttcctgcttgtgatttaaacacagggctccttttggggctccacccaggctgctggccacagagacccaggaaaaccctccacagcctgaggcgaagtaggcaggtggggggcagggacaggagcagggacagtggcagcctgagccccggtgaggcagggtgtgcggtgaccttaactgcaggcagcagggcctgaaaccaggggcagaagcatgtggttccccaggaggattccagactgccagccatggggtccttgaggcagggaggatggcatttaattttgtaaactccatggcacctggttcagcgcaagacacacaggagtgtggaaagaaccgtcttgccgaagattcgctctgcccacccctcccttagtgctggagacaatgccgtgtgtggggaggccca

SEQ ID NO: 91624 - DNA, 508 bp, Homo sapiens
tcttaagcttactttttcttagaaattgttttcaagctttctattatgaaaatttcacatataaccagagtagacacaatggtagagataatgaactctcacccagtttcatgaattactaattcatagatagtcctgtttcacttatgtcccgcttcttccttactcttgccccagttattttgaagcaaatttcaaatgtcacctttcatttttaaatatttcagtatgtatctctcaaataatttaagatcgtaacttaaagagaaaaaagcattatatcttggtttctcttaaaagtagtgtggggctgggcacagtggctcatgtctgttatcgcagcactttgggaggctgaggcagctggatcacctgaggccaggagttggagaccagcctgaccaacatggcaaaaccccgtctctacaaaaatagtagccaggcgttatggcacgcacctgtagtcccagctactcaggaggctgaggcaggagaatcgcctgaaccc

SEQ ID NO: 91625 - DNA, 441 bp, Homo sapiens
aaaatcctgtatccctttgtggtaaaaaaaaccctcaacaaattaggcacagaaggaacatacctcaaaataataaaagccatatatgacaaactcacagccaccatcatactgaagagagaaaagctgaaagcattccccctcagaactggaacaaggccgggcacagtggctcatgcttgtaatcccagagctttgggaggccagttcaggaagatcacttgagtccaggagttccagaccagcttgggcaatatagtgggactctttctctcaaaaaattaaaaaatttgctgggcatgatgatacatgcttatagtcctagttactcaggaatttgaggtgggagttcaggagttcaaggttacagtgagttatgatcatgccagtgtactccagcctggacaatacagtgaaaccctctctctaaaaaaaagaaaa

SEQ ID NO: 91626 - DNA, 360 bp, Homo sapiens
cccatgcataaaacccttcagtagctcctaattgcctacaaaactacagaataaatataatactgaggaggtgagggagggaaattatagaccaatattactcatacatgtgttaaagtataagtaaaatactacttataggattcggcagtacaacaatgaaaaaaaaattcaagatactttcagaacatacattctcattgagagtgatactgctctcaaggggtaaaactggttcttaggagaaaaaaaaaatctcagatattacaatagtttctggccatagtacttaaacagatatatggtatatctgtggtattaaattttcatgggggtgggggataattaggaactaaaatg

SEQ ID NO: 91627 - DNA, 224 bp, Homo sapiens
aaaaagaaaaaaaaatttttatcaggcaacacttcattctataaaacagaataagtgttccagtcacagaagtattttttgttacaagtatttttgtgtaagattgcaatggcctttgtgcaagattgtggtttttgcagtcttttgtaatagtttttgttatcaggtatttatgcttgagaactccctcttcatggccttccttggctgtcaggtttttttgt

SEQ ID NO: 91628 - DNA, 301 bp, Homo sapiens
cactcacagtgaaatggtcacatcatgatctagttttcatcctgattgaaaaaaaaaatctttgtgaagaaccctacaaatgtttttggtaaaagagattcacaataaaagaagaagaaaaataaaaatagagcgatgaagaggtattttttcaaaacatgagagccgaagtcggagataatgtcgtacatgagacagtgaatgtaggagagtgcccccctctaagtgcattattcccctttcatttagaatacagaaaagagtcagaggaagacaaaagaaaaggaaagaaccaaacttc

SEQ ID NO: 91629 - DNA, 370 bp, Homo sapiens
attgcatgttaaaattgctcttttaaattgccttctgcttctgggtaacccattgtggaactgctttatgattaactgacattttagcagcatctctctcatagggaaggtcaatagttcagagtgtccagaacataatacatttatgcagttgggaaaactactctctactcttatattgaagttcaatgctcttggcaattttcagtgaaacagttagatctatgaagcagtgaaaaggagagtgtcttattttaaaagtaagcatttactaaaaatgcattttttttcttgtcccaaatccaaaatggaaggaaaaacaaaacaaaataatactcaggcatataccagaaaccacaaagtgagaagt

SEQ ID NO: 91630 - DNA, 234 bp, Homo sapiens
ttgtaaagagcataatttctcccagtgaatggcagaggtatgtttagtgcaaatcaagtgaacatatatgtataggtctgtttctgggctttttgtcctttcattatgacgtgtctatacttaagtccagaccacagttttaattattatggctttatagtgagtcttgaaaacttgggtataagtcctccaactttgtacttccttgtttaaaaactatcttggctctcctag

SEQ ID NO: 91631 - DNA, 428 bp, Homo sapiens
caaaaaacagccagatctggtggcacacacctgtaatcccagctactcaggtggctgaggcagggaaatcacttgaacctggaggcagaggttacagtgaaccttgactgcaccagtggactccagtgttggcaacagagtgagattctgtaaaacaaaacaaaaaagaaaaaaaaacccaaaatctggcttttcatccttgagactacatttcaagctttttgctattgagtagaaaggaacttcatggtgtagttccatacatttctgagctataagaaaaaggtatagtgatgatgtgttaagtgccatgcttcagatctgaaggttgtgtaataattttcatgactgcgcttgtacagacgatttcaccattggctgcagttctgattttaagttcatttgctcgttttcatgttgaagttgac

SEQ ID NO: 91632 - DNA, 474 bp, Homo sapiens
cttccactaaaaggaaacctgctgtcattttaatcagccagtattatatctgatcactgtagttcttctgattaagatatgcagtaactatttaaaaaaaaaaaagctgtttcagtttcagaagttttttaaaacctgccaccgaagtgacattggaactccttctttggtttcatcaagattcctaactcatttcagaacctgttttatttttctttttttcctttgagaaaactgactagcacactttatgaaggtaccgacgttcacatcctagggctgctgtagcacaaactgggtggctttcaacaacgggaatgtattctcatagcttagtgctgggagctgcaagcctgatgtcacagtgttggcgtggccgccccctctgaaggctgcaggggaaaatctgccccgtgccttttcctttgggtgtgttgctggcggtctctggcactggtcatctgtaaccacatc

SEQ ID NO: 91633 - DNA, 383 bp, Homo sapiens
aggcagaaagaaaagagaacaggagacttggagtgggcagcagtagagcggaacccagcaggcccgcctttttggattcctctgggggctctggggatgtgtgttgtgggagtggagagtggtgacgagcagaggacggacagctgctgaaagcgatcattcctctccttgtggggcatcctgggaagaacatgggtgatctctgcagtcaggcagcgcagtcctcgtggggccttatggggcggctctgggtgtctgcattctaatccctggcaacaaatggggctgcaaggctgggctcctggtagatgctcaggaagggttgttccactcctcaccccctcctgagctgctttctagcctcgcagccccgtctttggatc

SEQ ID NO: 91634 - DNA, 425 bp, Homo sapiens
agcgtttctattcactctttgctctcccactggaggcaaaaagctacacaggctagagagtgaccaggcaagagagtcacctgatcaccatttgaagcgtttggctaccagaggtctgtctaagggaggctgttggtttgttcttcaaggttttcatttttttgatctagagcaggagtcagcaaaccgccattgccaggccaaatccagaccactgcctgtttttgtaaacaaaacttcatggggtagagctgtgcctgtttgctcctgtctgtggctgcttttgtggtatctcatcagagtcaacgcagtcgtgacagaggccatatggcttgtaaagcccaaaaggtctactgtcttagccaggcacactagctcacgcctgtaaccccagcactttgggaggctgaggcgggtggatcacc

SEQ ID NO: 91635 - DNA, 422 bp, Homo sapiens
caagttcatcacctagactaggtaatgtttcatctgattacctaaaatttcaatttacctaaatattactctgaaagttttgcactgaataaaacaagattattgttttaaaaagtattgatgagttattaaaagtgatagaaagtgggaagaaagctgatacagtcatatggcaatgaatgccattaaaggtttgttttttttttaaagttaaatatttattttgtgatacaggtttttaaacatatgaaattgatttgcaatcaagacaaattttgttcttaaaaagatcataggctgggcgcagtggctcacgcctgtaatcccagcactttggaaggccgaggcaggtggatcacaaggtcatgagatcgagaccatcctggctaacatggtgaaaccccatctctactaaaaataca

SEQ ID NO: 91636 - DNA, 458 bp, Homo sapiens
gctgtcttagttcattttgcattgctgtaagggaatacctgaggctgagtcatttataaagaaaagaggtttatttggctcataattctgcaggctgaacaagaagcatggcaccagcatctgcttctagtgaggacctcaggaagcttccaaccatggcagaggtgaatggggagcaggtatgtctcatggtgagagaaggaggaagagaaaaaagaacattcatattttgcaggaactatgagtgagaactggctcaatcccttgagaatggcaccatgacatttatgagtgatctgtccccatgattccaccaggtcctacctccaacactggggatcaaattttaacctgacacttggaggggccaaatatccaaactattattctttccctggccccccaaatgtcatatccttctcacattgcaaaatataatcatcccttcccaataattt

SEQ ID NO: 91637 - DNA, 500 bp, Homo sapiens
atgtgagtaatatatatatattagagacagggttttactctgtcgatgatggagtgcagtggtgtgattacagctcactgcaatctccaactcctgggctcaagttatcctcctatctcagccttccaagtagctgggactacagatgtatgccacggtgcccagctaattattcttcatttaattttttgtagcaatggagtcttgctatgtttccctggctgtcctcaaactcctagtatcaagcagtcctcctgccttggccacacgtgtgtgtgtgtgtgtgtgtgtgtgtgtatatatatatatatatatatatatatatatgttgcctatatactcccttcctccagtaccccaaaatatataagttctgaagacagaaatcttgtcactctactggcagggcttggaatagtgcccggcaaatacggatgctcaatatgcatcttatggataattttttaaggtgcaatcattattgtttcaaatatttttag

SEQ ID NO: 91638 - DNA, 1076 bp, Homo sapiens
aggctgccttctagtaccaaatgttataatcagataattgacctggtgtttgtggtgatctgatattatcaggaaaagcattactctgcctttttaaactcttaaattgatacaactgctggaagaagggaggacagatccaagagatctaatttgtatataatgggagttccagagtgaaatacaagagaaaagccagatttaatagaagtaaatttcctgagctgaataaagccttatatttgcaggttgaaagtgttcactaaattctaggcaggattgatgagaaaaggcatacacctaaacatactctgacagaattcctgaatctcaaagttaaagagaaaaatatataagattccagacagaaagaagttatttgcaatgggaaaagaattggactggtatcagacagtggaatcatatctatacctgttaagagaaaaggaaagtaaccaagaagtctctttccagccaagcatcattcacctgccagagtgaaagggatgcagaaaggattccaagaatctatcatctgcatatccccatctgaagaaactgaaaagaggactgtaactaaataacaaattaatgagaatagagacttcaagaaatgagaaggtaaagtagaaagggaagatgatgagtgaacaataagccttgtaatatacatgggtatgtatcttaatgtacttggatgatgatgaaatgactgaaaatgtgtactatatgtgttaaataaagactcttaagataaatgagactcatctaactagagcctgggagtaaaagttacaatttttctcagcaaaacctaagaggtggtattggaggaaagggaggaagaagtaaaaacattctaaaagttttatcttattgggtggagggaaagcatcaaggaatagagtaacttggtggggaaatagtatattcttacataatagtaataaaatatgtgtttgatgatgtgtattaaaaaaacataaccactagtggagtgggaaagcatagtgtcattttgaaattataagaggaaacaaaggaataaattgtaacttgatcataccagtatatat

SEQ ID NO: 91639 - DNA, 782 bp, Homo sapiens
ggtgcctggcagaaagattgaaacgtagtaggctcttggtatgggaatgcttatttccctgcttctctccctcagttagggttattatcgtataaaattattttagattactcatataattgtgagtaacctaaattatatgagtatcatgtgggcataatgtcctccatgttcatccatgttgttgcaaacggtaggatcctctcctctacccccctttttttaggctgggtaatattccaattcatgtatacaccacattttcattgtcatttgccatttagattgcttccatgtcttgtcttttgtaaataatgttacagtgaacatgggagtacagatatttgttaagagggtaaatcttaggttgtgttcttaccacatcctccaaaatcataataaataaagaagatagaatggggggattggagaaatgtcggtcaaaagaaacaaattttcagttaggagaaataagctcaagagatctattgtacattatggtgactgtagttaataacaatgtattgtatatttgaaaattgctaagagagtagattttaagtgttcttatcagaaaaacctaagtgtgtgaagtaatgcttatgttaattaacttgatttaaccattccacagtgtacacgtattccaaacgtcacattgagtcagggccagtggcacaggcctatagtcacagctacttgggaggttgagttaggaagatccctggagcctaggagttctagtccagcttgggcaacatagtgagaccccatctctattt

SEQ ID NO: 91640 - DNA, 246 bp, Homo sapiens
  misc_feature (6)..(10): n is a, c, g, or t
  misc_feature (69)..(69): n is a, c, g, or t
  misc_feature (241)..(246): n is a, c, g, or t
ccttcnnnnnaatattacatgttttattatcctgtccccagagggtggtttatccagaaaccaagaaanaaaatcaatcagaataaactcaaaaaaaacggcacgagtgataattggcctttaatatttgtatctctaattttattttctctctgttactgtaaaataatagctataatgtataacaattttcttcagaagaattctatgctattattaaaataaaatatttactgtgtannnnnn

SEQ ID NO: 91641 - DNA, 3056 bp, Homo sapiens
  misc_feature (979)..(979): n is a, c, g, or t
  misc_feature (1331)..(1331): n is a, c, g, or t
  misc_feature (3051)..(3056): n is a, c, g, or t
aggccggcaggctaggcgtggacccaactggcgaggctgctggggttgcagcgggacagttggggcggccccgcaggcccaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatngaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagnactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagtttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgtannnnnn

SEQ ID NO: 91642 - DNA, 2253 bp, Homo sapiens
  misc_feature (2248)..(2253): n is a, c, g, or t
aggccggcaggctaggcgtggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagtttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgtannnnnn

SEQ ID NO: 91643 - DNA, 617 bp, Homo sapiens
aggccggcaggctaggcgtggacccaactggcgaggctgctggggttgcagcgggacagttggggcggccccgcaggcccaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctggtatgacatcatcctatttgtagtagcaagttgaggctctattttagagatatgcacaaagatatttctaatacaaatgaaagaaagagctagggaaaacttcaaaaatgggaaaatatggttttctaggattttcttttaaaaataaaaaaatgcaattaaaaaaa

SEQ ID NO: 91644 - DNA, 2804 bp, Homo sapiens
  misc_feature (727)..(727): n is a, c, g, or t
  misc_feature (1079)..(1079): n is a, c, g, or t
  misc_feature (2799)..(2804): n is a, c, g, or t
aggccggcaggctaggcgtggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatngaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagnactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagtttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgtannnnnn

SEQ ID NO: 91645 - DNA, 1612 bp, Homo sapiens
cctggtacggtccgaattctttggatcgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggcctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaaggactcaggccaccctcgcttgtcctggcgcccggcggcagctgccagaaacttcctgggagaaagagccctcgggctgctttccctctgcgtgttcgaagtgggatgacagtcggcacggaaaacaagaggaagctcggctcctgagctctgacccagctcaaccgaaaagccagctggggctctccggcaagaagccgagacg

SEQ ID NO: 91646 - DNA, 1658 bp, Homo sapiens
agcgggcttagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggcctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaaggactcaggccaccctcgcttgtcctggcgcccggcggcagctgccagaaacttcctgggagaaagagccctcgggctgctttccctctgcgtgttcgaagtgggatgacagtcggcacggaaaacaagaggaagctcggctcctgagctctgacccagctcaaccgaaaagccagctggggctctccggcaagaagccgagacg

SEQ ID NO: 91647 - DNA, 996 bp, Homo sapiens
tttatagatgcagaaaaatcatttgacaaaattctacacccattgatgataaagaactctgaccaaactagaaatagaaggaaagttcttcagccaaataaagagctaccacaggaacatacaaggaaagctgagagaatccacagaccctctgaaggaactggatcgccactgcaggctccctgagatgctgaaaaactcaccattcacaatagcaaagacatggagacaacctaaatgaccatcaatagtagactggaataaagagaatgtagtatatatacaccacggaatactatgcagccattaagaagaaccagattcatgtctgtctcaggcagtggtgagacaagatggtggatccccacaccattatccatcagaccctgtgctccatagggaaagggcatatgtgactcagaggaatgtgtaggacaattgccaagcgcaagacacatggaggatcctcatacagtggctgggtgaagtgacttttgttctctactgcaagtagtgatgtctcagtgaaggtctatcaatgagaagaaagtgccaactgaaaacttttagaaaatacccagtttactcaaggaaaataacatgcattgaaggtgattgctcaatagagagaagttgaaacagcagactaattgcctgtttgtgacacccatgtaatcaacttggtgaaagttacattgatacagacacaagcgaaaaatttgatggccaataggggacatgatccattttccagtgcctataggttgaggttgatctgaaagataggactatttgtgatccagaatcaaaagagtcaagaaaagtctgagaatttcatccttggagcagaaagtgaaagtgttctggagccaaaagtagtaacaaagatggagggcaagagatcattggattaaatcatattggcagaccaaatttcagaagaatcaacacaccagagacaagaagaacttgaagttaaagcaaagttcccttata

SEQ ID NO: 91648 - DNA, 712 bp, Homo sapiens
ctgctgtggaacttgtctctgtctctttttctgatttgtccctcagtcgaattatttcttctgaggaggcaaggactgaagttgctacagacccctaaggacaggccatcggtaacactgggtaaatcagatctcttccacgggtctatcaatgagaagaaagtgccaactgaaaacttttagaaaatacccagtttactcaaggaaaataacatgcattgaaggtgattgctcaatagagagaagttgaaacagcagactaattgcctgtttgtgacacccatgtaatcaacttgccatttgtactcatcagttcaggctgtgttttcccactgagacatcatttacagtgctctaaacatattttcacaacattcacctgacaacatcagctgagagaaaaattttcagactgccgagaaacatcaggaggccatgaattcttaatcaacacaccaaattatgaaaatggcctataggttgaggttgatctgaaagataggactatttgtgatccagaatcaaaagagtcaagaaaagtctgagaatttcatccttggagcagaaagtgaaagtgttctggagccaaaagtagtaacaaagatggagggcaagagatcattggattaaatcatattggcagaccaaatttcagaagaatcaacacaccagagacaagaagaacttgaagttaaagcaaagttcccttata

SEQ ID NO: 91649 - DNA, 1095 bp, Homo sapiens
ggaaacaaaaaaggaaaaatgtagcacagtaaaatactataagtcatttaaataaaaatacactcaactccgtctcaaaaaaaaaaaaaaaaccggaataccagattgttgtccttttgttttcttgttacacatttgagcccagattttgacttaatgtgtattatttatttttatgttatctcctttctgcttagttgactttctagctgagtggtgcacagtgcatggaagattccacttagccggaccaggaagcttggtctcatctgtggtgcacaccaacagcaaacattgatgtaattctctacaacttaatctttggcacatagaggatttgggggtctccatgttcagggcacaatggctttaataagtgctggaaaatcactgaagctaaaccaagagcaccagatcctctttacctaaatacccagtctttaacatgagctagtccctgtaccatagtattgtttcagctgtagttggttgtcatgttaataagacagctgcacgtctaccttcttttcttttgatttccattgtcttggtaagttattgttagggttatttttaatgtgccttccagccagaaaaatcagctgtctaaagaagcattgcaattgtaatggggactcttacctcttagaatgcaagattttccctcctccctccctcttctccatctctttccctcatgatttgagaactgtaataatcctccactggtggcattacctacctagaaaacctgctgattcttagcatggaactttgcttcagtttgcaggacaaagtctgcttccttccggtcttcatttactttttatacaagggatgcagtcagctctccatgtataagatacctagatgatggatacatatttcataaatgaaatttatgtcattaatgaatatccccttgcccacaaccagctcaggctttcaaaattcgagaatggtcatgccacacagcattctaatctagatggattaattctgttgttcaaaacattctcatacctgcctttatattgaaaacaaattctagatacaactggggttattctggaaaagcacattctcacctttttt

SEQ ID NO: 91650 - DNA, 1149 bp, Homo sapiens
ggaaacaaaaaaggaaaaatgtagcacagtaaaatactataagtcatttaaataaaaatacactcaactccgtctcaaaaaaaaaaaaaaaaccggaataccagattgttgtccttttgttttcttgttacacatttgagcccagattttgacttaatgtgtattatttatttttatgaaaattgtggacacataaccaagataaagaagtcaggtattccatagccattccttatctcctttctgcttagttgactttctagctgagtggtgcacagtgcatggaagattccacttagccggaccaggaagcttggtctcatctgtggtgcacaccaacagcaaacattgatgtaattctctacaacttaatctttggcacatagaggatttgggggtctccatgttcagggcacaatggctttaataagtgctggaaaatcactgaagctaaaccaagagcaccagatcctctttacctaaatacccagtctttaacatgagctagtccctgtaccatagtattgtttcagctgtagttggttgtcatgttaataagacagctgcacgtctaccttcttttcttttgatttccattgtcttggtaagttattgttagggttatttttaatgtgccttccagccagaaaaatcagctgtctaaagaagcattgcaattgtaatggggactcttacctcttagaatgcaagattttccctcctccctccctcttctccatctctttccctcatgatttgagaactgtaataatcctccactggtggcattacctacctagaaaacctgctgattcttagcatggaactttgcttcagtttgcaggacaaagtctgcttccttccggtcttcatttactttttatacaagggatgcagtcagctctccatgtataagatacctagatgatggatacatatttcataaatgaaatttatgtcattaatgaatatccccttgcccacaaccagctcaggctttcaaaattcgagaatggtcatgccacacagcattctaatctagatggattaattctgttgttcaaaacattctcatacctgcctttatattgaaaacaaattctagatacaactggggttattctggaaaagcacattctcacctttttt

SEQ ID NO: 91651 - DNA, 1096 bp, Homo sapiens
cacccttcctggagctgtccaggtgccagggtccaactcctccctcaaggaatcctgtcacacgatgtgacatgcaactgtgttgccccagctcggagcaaaggcggacatggacataccggcaggagagtcctccacagggggtccgttactctgaagaacgtaatgccaatcagcttttatctcctttctgcttagttgactttctagctgagtggtgcacagtgcatggaagattccacttagccggaccaggaagcttggtctcatctgtggtgcacaccaacagcaaacattgatgtaattctctacaacttaatctttggcacatagaggatttgggggtctccatgttcagggcacaatggctttaataagtgctggaaaatcactgaagctaaaccaagagcaccagatcctctttacctaaatacccagtctttaacatgagctagtccctgtaccatagtattgtttcagctgtagttggttgtcatgttaataagacagctgcacgtctaccttcttttcttttgatttccattgtcttggtaagttattgttagggttatttttaatgtgccttccagccagaaaaatcagctgtctaaagaagcattgcaattgtaatggggactcttacctcttagaatgcaagattttccctcctccctccctcttctccatctctttccctcatgatttgagaactgtaataatcctccactggtggcattacctacctagaaaacctgctgattcttagcatggaactttgcttcagtttgcaggacaaagtctgcttccttccggtcttcatttactttttatacaagggatgcagtcagctctccatgtataagatacctagatgatggatacatatttcataaatgaaatttatgtcattaatgaatatccccttgcccacaaccagctcaggctttcaaaattcgagaatggtcatgccacacagcattctaatctagatggattaattctgttgttcaaaacattctcatacctgcctttatattgaaaacaaattctagatacaactggggttattctggaaaagcacattctcacctttttt

SEQ ID NO: 91652 - DNA, 180 bp, Homo sapiens
tggcatcctgaagattaacatcaggatgggcagcttgaaaaatggcttataggtggcattttagtttccttagcaactcaattttcctagatcatatctaaataaaaataattatgctttctgcagtagaacaaggtcattctgacctcctcaactctcttttagctggaaattaggcaa

SEQ ID NO: 91653 - DNA, 461 bp, Homo sapiens
atcacaggacaacgtaagttacacagtacaagttattctggattccaataacctagggttttcagggaaatccttccaaaaagtatagtttttttcctgcattcttaaaatgagcttaatatcattctgcctgttcttgctatgtcaggctgccattgatccactggtgagaatgcaggctcaggtgtccacggagccaggaagtgggcttcaatgcccttctttctgaggaggattcccaggctacattttcttgccactcacctcctcctctccaaggagaaagaggtggcacatgacctactggaacatgtgggctatctacctttttgggatataacatcaaaggccagggccctgaattttcatgctgataacagtcttctcaaccattatcttctgcctgatttgtcagcagcattccacctttattttggatttgttttattcagaagtctgta

SEQ ID NO: 91654 - DNA, 302 bp, Homo sapiens
tacttgacaggggagaagaggttgacattaggccatgtcattcaaacccgttctgcaaacaggaaaacaggaagtagaaacgccgcacacagatagttaaaccttgggattcagactctgatggctctgatgatatggtgatttgtgtgctggggatgaaagaggagcagaagactgagcttacatctcttcagacgaaatgcaattttctctattctttccctgttactattgttacgaccaagcattttcattgatccattatcatcttcatcttgagatcacaaaggaagttaattgcc

SEQ ID NO: 91655 - DNA, 394 bp, Homo sapiens
ttttctttagaaaaggttgaaaaatagagttctgccttataaattcatgttatttgctagttcagtaaattactatttttttctatttctaggcattttatcttttcatcctcacaaatgtattctaaattcatcatttaaatatctttctgattgtaatcttgctgaataccagttttgttttccttatattgctttagtctctcttgggctcctttcaacctacttggctattccccctttttgaatgacctcattctttctgaatcccacacatcttctgttgattactaaggtctgtgcttaggattcacagtttcctcttctctctcacacgaatacaatctatgttccttttcacaatgaaatatttgctacagttccataacttatt

SEQ ID NO: 91656 - DNA, 212 bp, Homo sapiens
ctcagctccacaggggagactgaacctgtgtcttttcagaaatcaaccaagtcaccccagcaaagaggatgcaaaggagaggtaaagccatgtcttcctcgagggtgggacccggcaggtccgagtattccttccagatgctggcaatcaggactccagctcagcgtgcagtgtttgggaacattgcccctgctgaggtacttcctgcccct

SEQ ID NO: 91657 - DNA, 190 bp, Homo sapiens
agagcaaaactctgtctcaaaaataaaaaataaaataaaataaataaaaactcaagaggttcacctgtagacatgcctctagcaggttcccaggcacctgtctctctccatctcttgcctctgctttgctctgttatgttggcattttaggcagatcttcccccattcggcagcagttatggccatcagc

SEQ ID NO: 91658 - DNA, 339 bp, Homo sapiens
ccatatttagaatgcaagaaaatgcatacgtttattaaagtgataaaaatcactttggccatatttattcattctcttatgtctttcgtaagaagacataaaagacacctctttccctgggtaacatagcacatcccagataactgtgattttttttttttgtatcatcaaaggaaactgaagagaaaaaccaaaagaaacaaagccaatatgactgttatgtgtcattgtacagtttcttgagtttgttgcagagtgaaaattacttgggaaaaattccaaagtaagctttcgtgttgccccaattcatataaaccaataaaagattttctttcctag

SEQ ID NO: 91659 - DNA, 357 bp, Homo sapiens
gtgtggcagctcacacctgtaatcccagcactttgggaggccgaggtggtcagatcatgaggtcaggaaatccagaccatcctggccaacatggtaaaaccccatctctactaacaatacaaaaattagctgggcgtggtggcacatgcctgtagtctcagctgctggagaggctgaggcaggagaatcgcttgaacccaggaggcggaggttgcagtgagctgaggtcgcacaactgcactccagcctggcgaaagagtgagactgcgtctcaaaaaaataaaatttgagctcagatttacatgttataactcattctggagtcagaatttcacatcttgtgaaggcagagcagat

SEQ ID NO: 91660 - DNA, 163 bp, Homo sapiens
aatcagctcaagtatcacctcttccaggaagcccctcctgattgctcctgtacacatgcacaacagagtgcgtcagacgcgattctgctcttatcctgagacttctgggctttcatgccactggtaacaactgcttgtgtctgggtctgtctcccctatgagc

SEQ ID NO: 91661 - DNA, 353 bp, Homo sapiens
gagatggagtctcgctcttgttgcccaggctggaatgcaatggcactatcttggctcaccacaacctccacctcccaggttcaagggattctcctgcctcagcctcccgaatagctgggattacaggcatgcaccaccacacccggctaattttgtatttttagtagagacagtttctccgtattggtcaggctggtctcgaactcctgacctcaggtgattcacccgcctcggcttcccaaagtgctgggattacagaggtaagccactgcacccagccgtattactcttttaagaaattacagactttggatattccactttaccttcttggaaatgtccctcctgggccc

SEQ ID NO: 91662 - DNA, 523 bp, Homo sapiens
acgttggtgttcatgaacaatctgagcactccatgtggaaagaagcagatacagctgtaggacccatgagagtaagcagaccttgcagacctgaacctggatgtgtaagagcgccttcgtattttatctttgaaacacccatagagaaagggggctgaacaagggtcaatgagcagccctggagcccagattaagctctccataccacttcccatggaaggaaaccaagactccctggagacagacacgtggctgatttcaggcctagggtagaagaagtacaaaatggcacagaacatgctggcttgtcataccatatcaaaatgaagcaattgaggaccgcgagaactgcatcacaaggctcaggggccaacacaaagatggaacgacgtggacatcggtgaagaacgaatagagtaagtcatgcattcaatagggtggccacacacgccacaccacacacacctaggcgcacacactgacatgcgtgcgcacacacacatcactcacatccacacacacc

SEQ ID NO: 91663 - DNA, 142 bp, Homo sapiens
tggtttgtgcttttggaagaactaggaggtgggacgcttctgtgccgtgtcaccgatggatggaaacaggaggaatcctgtctgtgttcaagcagacccactccgctgaggacttgggaacaggctgcagaatgacacgcgc

SEQ ID NO: 91664 - DNA, 300 bp, Homo sapiens
gtttcaccatgttggtcagggtggtttcgaactcctgacctcttgatcagcctgcctcggcctcccaaagtgctaggattacaggcatgagccaccatgcctggcctaagcctatgtttttaaaagccatagaaagagactaagagtgaaaatcattgtgaaaagagcttgaatatctcttgtgactccacctctccttaaatatttataagatgtatttgctagattgatgtgcatgttcagttctaaacctttgaagtaatgcagaaaccaaatactgtgttggttaatggtaatgca

SEQ ID NO: 91665 - DNA, 307 bp, Homo sapiens
tcccaagcccaagcgattacacggcctcagcctcccaagtagctgggaccataggtgcgcaccaccatgactggctaatttttgtatttttagtagagaagtagtttccccatgttggccagactggtcttgatcttctgacctcaagtgatccacccacctcaacctcccaaagtgctgggactacaggtgtgagccaccacacccagccaccttcttcactttcaatctgccaccatctaacactctgcacctctcaccctgtgattttgtttactatgtgcctccctcactgggctcttagctc

SEQ ID NO: 91666 - DNA, 397 bp, Homo sapiens
ggagagagaatgtgtgagcggcaactttgaggccttgggatgtgcagaaggggtcgagtgcaaatgtttggggacctgcttcaaaccttgtcctgtgagcagcttgtttacacaactaaccatacattcttccagccagccccagaatcctgagaatataatcaaaagcatatccctaagatgcaaccagattcatccagtgatttaattttaagcactgcttcgccattttattccataatgtacttagaagcacttacaatgtctgaaattaatcaacagtgtccccaccggttcctcgtttctttcccacccacgtatattattagcaggttatatctccacctttcaagattcacggttatgtctacgacgaatggtatttgccttgactttc

SEQ ID NO: 91667 - DNA, 1609 bp, Homo sapiens
cggccggagccggagcggatcctggagccggagcggagcggagcggagcggagccggggcggagcgggccgagcgggccgagccagcagccgagctgggggcgcgggcgggcggcatgtaccgggcccgggcggcgcgggcggggccggagcccggcagcccggggcgctttgggatcctcagcaccgggcagctccgggacctgcttcaggatgagcccaagctggaccggatcgtgcggctcagcaggaagttccagggcctgcagctggagcgtgaggcctgcctggcctccaactacgcgctggccaaggagaacctggccctgcggccccgcctggagatgggccgggctgccctggccatcaaataccaggagcttcgtgaggtggccgagaactgcgcggacaagctgcagcgactggaggaaagcatgcatcgctggagtccccactgcgcgctgggctggctgcaggctgagctagaagaggcggagcaggaggcagaggagcagatggagcagctgctgctcggggagcaaagcctggaggccttcctgcctgccttccagcgtggccgcgccctggcccacctgaggcggacgcaggcagagaagctgcaggagctgctgcggcgtcgggagcgttctgcccagccggcccccacctcggctgctgatccccccaaatccttcccggctgcagctgtcctgcccactggggccgcccgggggccaccagcagtgccccggagcctgccccccttggactcccgcccagtgcccccactgaagggctcccccgggtgccccctcggcccggcccccctgctgagccctcggccctcgcagccagagcccccccaccggtaggatccacggtgcggccccccagttggggggcctagacaaacttgatgcgtggctcctcctcctcccccactgcctgggtggggggaggggcaggcccctccccctggcctcaggcaggccctggccctggaggctgagctggggaggagggtcccctggaagaggcccgagagggggctgggggtgggtgggcagggctttatgcctctggcgctgaagacaccctgccttttttgtttccgtgccccggggcctctagggtgatggaccagccccgttaaagaacttgactcaactacaggggcctgggaagatgcctgggtcccctaggggccttgccaaggggacctgtcgcaccccaccactccactgggctcgcacaacgccaaggccgccaggagtgttttacatcatgtcctgagcctacctttcccccaaattctggggcccacagcctaggagccaggtgatcaggcctcggctgtggggccagggacaccatggccctggggctactacgtgtccacacatgctccagaccctggggcaaggtaggccaggggcttctgacctgtgcaggtgagagtgggccatacccaggaaagaccattctgtatttttctgtccctgtctccttagaatggaagctttttgagggcaggtccttgtctttgtacgttctgtccccagccccgcctcttaggggccgtcaataaatgtgatgatgaggatgaaaat

SEQ ID NO: 91668 - DNA, 357 bp, Homo sapiens
aaaaaaaaaaagaaggaaaagaaaatattaatgttctattgtagaacccttaaaaggaccttaaagatgaaccaattcaacttcactcatttactacataaatgcctttttcaaattcttcatgtgacagaaaaatgagttgagctaacaaaatgaaggcagaattgttaatctgataacagtagtatgaataattcaacagaagctaggaatttttgtactgatacattgactcatttacaaagctagaaggaacttttctgctgtttgtaaaatttttgtttagagaaaacccaccaagcaatagagtgaacatttagtaccttaatcttagatgatgaattcgttaaagaattt

SEQ ID NO: 91669 - DNA, 318 bp, Homo sapiens
cagaggtgagggcagcacacccgcagcagctgtccaggcctgagccaatgcaaccctgggcgggaaggccagctcaccgtgagcaggtagaagccagccagccacccaggcagggaccttggttctccccacacactcccaggagcagggaacaggggtggagtggcctttcccagagctggagttggctgcagcagctttcgaatcagacctgccaaggtgatgggcgtctgagtttcacatctgggccccccgtgaccccactgagtcctgacagctaaggatgggccacctccacagctccgtcactcgtacttg

SEQ ID NO: 91670 - DNA, 1101 bp, Homo sapiens
gtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgcccaaatct

SEQ ID NO: 91671 - DNA, 892 bp, Homo sapiens
tctctctctctctctctctctctctctctctctctctctctcagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgcccaaatct

SEQ ID NO: 91672 - DNA, 195 bp, Homo sapiens
agcttgatgctgtaggtgatctagaggatcccagcgagccgcacagtaggaggtgagcagtgggccggtgagctactgtgtgagctccaccccctgccagagcattactgtgaactccgccacctgtcagagcattactgtgtgagctccgccccctgccagagcattactctgtgaacaccacctgtcagagca

SEQ ID NO: 91673 - DNA, 457 bp, Homo sapiens
aattttaaaagattttccagcaaattctgatcctctcacctaaatgaaaatcagtacctttgcaaatccacttgaccaaaagtagaaactcccattgttccagttatcgaggactttatatctgcattgagtacaacaatgttctggtaagtgactagtgcttgggaatatttttcctttccttttcccactgtgaagataaatgaaggagcactatatagtgttagaattctctgctttgtaaagattctgtgtcctaaaagatggaatggatgataagtgaacaaaaggagaaaatgaagtgtcagaatgtaaatggacacaatgataaactttagaggtttaaaccagataggttcaagagtgcaaactagagtgattttccgagtacatccttagcccgacttaacctgaaagaaaatacatacaaaattgggaacctgaggtctcttacttt

SEQ ID NO: 91674 - DNA, 322 bp, Homo sapiens
tgttttctaatgatttttaatttttcagaggaaaataatttcaagaaataaaacttaattcccctgagtccttattgaattaaatattgaaaaacaatgaatgaatgatgcattcttattaatggactgtaagaaactgatataatggacttcattctacaattcggtttcttattgtcttacacatgctcctcgaacttaaacattttaggaccttaacaccatttccctagtacaattactaaaagaaagctttggataatataatatcagggaagatagtacaacatagtgaagatgacataggaagatgtgaggagca

SEQ ID NO: 91675 - DNA, 300 bp, Homo sapiens
ggtgacattttttggttcttaaaatggctactgtgttttccgcacggtgagactgcttatggagacataatgagaagtccagttgaacatactggagctgcacgctttgcacagagcgccttatggaagggcagctttagctatctagcacacagctgtgtgcctagccgcggcctggaaatcagagttgcctctaaggattgttagtaagaaaggaacagggcaggccttcctaaattggacctagttaatgagttaattttgagctttaaaatagaaatcgagttagtcacctcccaa

SEQ ID NO: 91676 - DNA, 696 bp, Homo sapiens
atttaattatccactgttaggtcagatttttaatgtataatttttattttagatatttttttcctagaacaagcatataggtgtttctataaatgaccgtgagaaattcttttatttctttaattttgtggtggtatttttataaagtgactgctttgtgctagggataatctatcttgaaatgactgcttttactggatgtaatctgtcattttaatttcctgttaacagatggtggttgcattagaaaaggctttgggttttattcatatcagaagctaagagcctatcattttatttcacctaacttttattagaagatatacatatatatatatatattctatgtgaaaatatacctaagtagaagatatttgtaagcttaggtaatagtttaactgttgtatttgcagctccattaaatgtcagaatcatgtgtccttgcagaaaagatagttatttgttctacttgggttatgttcctgatagtaatgtgagcgcagctggtagaggatggcattcctgtgagtctcagaaaatcctttgtctcgtgcagctctaatgctcaagggacacacttcactttccccttaccgagatagtcgaccgccaatcgtactggaggttatgaagtgtaatacacagttccatgcctttatcagtctgtataattgatgcattcagagctttaaagca

SEQ ID NO: 91677 - DNA, 954 bp, Homo sapiens
gatttccaaccattttgttcaaaactctcaaggccttggcaacgtgctctcccggattgcagagatctacatcttgtcccagcccttcatggtgaggatcatggccacagagcctcccataatcaatctacaaccaggcaatttcaccctggacatccctgcctccatcatgatgctcacccaacccaagaactccacagttgaaaccatcgtttccatggacttcgttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgtccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttgattgccggtttgcaattcaccccaggaagtaaatggtccttaatcctacaactactgtaaacccagaagggaaagacagtacacactggaattgtaaagcccttgtgaattgcttaggcagaaagttttctttcttaagccttcaggaacccagaataaggcagactctgttaaagggataaatagaggtgtctgaatgtgagtgtatgcatgctgcgtgtgtctgtgtttatgtttgtttgtttgtttggggcaagaaagattctaggacaagagctaggcatgtacttctgaccaggtgggtaagcaactctaagtctgtatttgtattggtcattctcagtggaaatccct

SEQ ID NO: 91678 - DNA, 167 bp, Homo sapiens
ggcctctccgagccctgcatattcccgattgctccaggagtgactgtcttctaacctcaagggctgaacagacaaaagtcatgacaagctgctcaaccaggaccctttagtgctagggctatgggcaggcccagattcgatactgcattttccatcgttagtcaagc

SEQ ID NO: 91679 - DNA, 794 bp, Homo sapiens
aggccgccaccgccaccgccaccgccaccactgccagaatcgcctctcgggggtcgccgggtgtctcccactcccccggcctcgggacggggcccgcagtccgcagcctctcccgtggaaaccgggcctcccgtccctgtgcgtcgcgagcgggctccggacagcgccagatgcgagcgcgccgggaagggctgcgaagactcgctcttcgggagctcgaatggcttcttaggaccccgcagggcgggtttccaggcctgccacggcctccagtgtgggcgtgacgagcgctcctccctggagttcagccctcggcttgggactgcccgctgggttgctcggaggccccggagcatcggaaagggcggctggaggctcccggagcgggctcagcctgggagcccagcgactacgctctgaaatcccgggctccattccatattttttggcgtttttagaagatggtcacggcccactttcgcttttcagaggaccggaaagccttaacagggagttttgaggaatcactaagaggcattgaagcttccgggattgggagtaagctgccatggaaagaaactcaggctggactactgcatgatgagagatcacatcaaagagaacagtccagccagcccaacttgagacaccagacatgtgatggagccatcttggattcctcaccccagccaacaccatgtggagcagaggcaaaccctctccatggagttctgcctgaattgcagacttgtgaataataataaatggccattttaagccgttaagatttagag

SEQ ID NO: 91680 - DNA, 446 bp, Homo sapiens
atgtgggtgggtcatcaccaacagttcctccctttcctatctgcatatgctggtcctcccatgaagaagtagaatttatttttcatgccgtaaatcttgactggtcttctaacttgtttatttcttggtctgggccttaagaggcattgaagcttccgggattgggagtaagctgccatggaaagaaactcaggctggactactgcatgatgagagatcacatcaaagagaacagtccagccagcccaacttgagacaccagacatgtgatggagccatcttggattcctcaccccagccaacaccatgtggagcagaggcaaaccctctccatggagttctgcctgaattgcagacttgtgaataataataaatggccattttaagccgttaagatttagagtggtttattatacactcataggccatgtaaatatcatctcact

SEQ ID NO: 91681 - DNA, 866 bp, Homo sapiens
tgttaaattttctggttctgaacattgcactgtatatataagtgagtgtttctgttcttaggaaatacctactatggtatatagtacagtatttaggggaaagggacattaggcctgcaatttattctcttttttatatttttattttctttttttatcatgtaatcttgctccttctaatgcaatttactctcaaatggttcagaaaacaataacctgtatgtatgtgtgtgtacatatatatgtgtgtatatatataggtatatataatggaattacatatatataattagatatatattagatctatatatagagatatgtaaatgaaatttcattatgttaacaattggtggatatggaagagtatgagggctctttaaaccattcttgtaacttttctataagtttgagattatttcaaattacgaatttaaagcagttcagtggtaggaagtgattttcatcttcacttggtggtctgttatgtgcctgcattgcagatatgattttgattcataagcatagctttgcttttctcagaaatcttttcctgctgagtcctcccttccctgccatcaagtacagaagagagcactcagaggtgctcaaaaaataaaagagcatgtgttgtttaaaataaaagactgctacaaatgtctacctgctgcttcagaaatgttccacctgctgccccagattcagcatctggcagcccacgtggttaaagaatgtcagcagctgtaatcccagctactcaggaggctgaggcaggagactcgcttgaacctgggaggcggaggttgcagtgacctgagatcgcaccactgcactcctgggtgacggagcaagactccatctcaaaa

SEQ ID NO: 91682 - DNA, 729 bp, Homo sapiens
tgttaaattttctggttctgaacattgcactgtatatataagtgagtgtttctgttcttaggaaatacctactatggtatatagtacagtatttaggggaaagggacattaggcctgcaatttattctcttttttatatttttattttctttttttatcatgtaatcttgctccttctaatgcaatttactctcaaatggttcagaaaacaattggtggatatggaagagtatgagggctctttaaaccattcttgtaacttttctataagtttgagattatttcaaattacgaatttaaagcagttcagtggtaggaagtgattttcatcttcacttggtggtctgttatgtgcctgcattgcagatatgattttgattcataagcatagctttgcttttctcagaaatcttttcctgctgagtcctcccttccctgccatcaagtacagaagagagcactcagaggtgctcaaaaaataaaagagcatgtgttgtttaaaataaaagactgctacaaatgtctacctgctgcttcagaaatgttccacctgctgccccagattcagcatctggcagcccacgtggttaaagaatgtcagcagctgtaatcccagctactcaggaggctgaggcaggagactcgcttgaacctgggaggcggaggttgcagtgacctgagatcgcaccactgcactcctgggtgacggagcaagactccatctcaaaa

SEQ ID NO: 91683 - DNA, 293 bp, Homo sapiens
  misc_feature (101)..(101): n is a, c, g, or t
atgttttagtcaaatacaactttactttccaccataattttacaatgaaatgttagtatatttaaacttaagagcttgggctcagcttcagtaggcctgtnatggcattgtttaactcccccacagcctgggcaacaagagcgaaactccgtctcaaagggaacaacaacaacaaaaaagataaaataccagcacatgaataacagacctgcaaggtaaagagtgagaagcaaagaaaggaaggagacacagctagcactttcagaaaaagaagtgagtaaatataattattg

SEQ ID NO: 91684 - DNA, 275 bp, Homo sapiens
gccatgcaagcatgtgggcctttttgccacatctgatttttcccttcccctcccctcccctcttccttcccttccttcctttcttcctccctctctccctccctccctccagtggcaccatcacagctcactgcagccttgacctcctcagggcccaggtgatcctcctacttcaggctcctgagtagctgggattacaggcacatgccaccatatccggctagttttcatatttgtttgtagaaatggagtttcgccatgttacccaggctggt

SEQ ID NO: 91685 - DNA, 437 bp, Homo sapiens
ccactgcacagcgtaattttaaatatgcaaacctgatgaatttaatcagaataaaaatcacattaacatacagacccaccaagagaataatcttaaaatgtagaattgtagatattaactttccaggtagttagagaattcagtgaatatttcccatttacttccactccaagtaactgcagtttttactacatttcaaaaataaggtttgatgagagaagaaaaaaactttttaaagcaagaggacctaggcatagtggctcacaccagtaatcctagcattttgggaggctgagacgggcggagtgcttgagcccaggagttcgagaccagcctgggcaacatggtgaaatcctgtctctacaaaaaatacaaaaaggatccaggcatagggttgctcgcttgtagtcccagctaaacccgggaggctgacatgg

SEQ ID NO: 91686 - DNA, 381 bp, Homo sapiens
tgctcaggttgccacagcttgggtcactggtccaaactacccaacattttgcccaaggcagattcagttggcaccactgctggctctgattcttcatcctgttcagaatatgcatagccaattctccagcgtgggtccgggtcaccccctcccatcctgcaccctgctgaacctcacatgttttcctgagacccccgcatggggatggcacttcctatctagctgacatagttattattatctagtttcttgactgagatttcttcccccaaaacacttccaaaagttaactttgtttttccttgcacagtgaaatttgtttaaccaagtttcagccactgagaataattttatgcttgaaagctttgacagttccaaaat

SEQ ID NO: 91687 - DNA, 421 bp, Homo sapiens
acaatgagcctacaactcaaagagttcgtcttactttgagtatgagatataaaagtgcggtaaaaaatcaacagatgagagagcaactggagaagatttgaataaaatcactccttttccatgtgggtcaacacagtaccaaataagaactgggcctttgatagaaaatgtaagggacaccctcatagtgacttctttcctagcagtctgcctctgtttgcggtgttgtctggggtcattgttgaaagttattgacatatttctgcctctttgtgagttatctgtgaagctacgccacagtactctgttgttggctattctgcatgctcccagtgctcaggtgaattccttggaagatactgagcaaaaacctagagcttatatgaccataatatctagaccattagcatgaactggtaaa

SEQ ID NO: 91688 - DNA, 314 bp, Homo sapiens
gtaaatgagactctaactttccattttgagagtctgtgtttcctatgtgactatcctccaacttcgtgttcaaataaactccacacttcatcatattttggattctaagtatttaagcttgaaaattgcaaagacacattatcatgtttatgcgctgtcatacatgttggaaggatgtctcttgtctggaattttgtgtttattttttagttaaaagggtttcttcatgtttcctgttaagaggctctaattggccaggcatggtggctcactcctgtaatcccagcaactttaggaggctgaggcaggtggat

SEQ ID NO: 91689 - DNA, 183 bp, Homo sapiens
caaggacggctcattctccgggcacgtgggacccactggagttgcacccatgtgcaccccgggaagttgctgcctgcctttcgcaggcatctggctggcctctcacacttctgagctgttccccctaaacctaagcgcgtaggtcaggcttcggccgcagctgccttctcatgattctcagtg

SEQ ID NO: 91690 - DNA, 425 bp, Homo sapiens
acttggagcccctgaccttggagccctttgttgtgcacgaagtctccatgacattgccctccagttttcactggtggggatgttatcttacacacatacgccaagagcttaaactgtcaacagagtctagttgatccactgaatccagtgatcttactaggataaccatttacctcttcttgtgccatcaaggaagttggccacaaaatactgttcagaggggataaaaagtcactttgccaaacatagggttcacatggtcccaccttggttaaaagtattttaaaaagcagctctgtgtgtatttgtggtgtgtgtgtgtgtgtgtgtgtgtgtgtgtgtgtgtgtgcttacacacagaaacaaactttaccccagggtgtgaggccgggagagtatgcacatccactcttgactacctatac

SEQ ID NO: 91691 - DNA, 176 bp, Homo sapiens
gactctgtctctaaaaagatttttttataaaaactaaacaaggcactatattgtatttatgctgataaagtaaacggactaaaattctgtttaacaaaagaagatgctgattaccctaacataaaacaaataattcaaaaaactatagacattttaaagaaaattctttttttttt

SEQ ID NO: 91692 - DNA, 270 bp, Homo sapiens
ggcagcagagccctagggtgatagcaaaagaaagaggccaggaagtgagacacagaggagaaagacttcagactgtggcatcagagccacagcacccagctgaatttgtttctttattaaatcattgaacagctgtaaacaaataacaggaactcaggtgccaggcacggtagctcacacctgaaatccagcactttgggaggccgaggcaggtggatcatgaggtcaggagattgagaccatcctggctaacacggtgaaaccctgtct

SEQ ID NO: 91693 - DNA, 154 bp, Homo sapiens
caggagctcctctgtgcccgtcatcaccccctttatatcacacatattcgctctcattctgggctacctggtccctgtcagaagggaatgtttgagttgatgctctggtacaaccacagatgtggttttcagactctcttgcttttttgtgagc

SEQ ID NO: 91694 - DNA, 483 bp, Homo sapiens
ggtgaggaggagcagggagtaaatggaaggtgaagaaggaattgtctttctgcaagtaggaatggaagggaagggttgatgcttctaagggaacagcatgagcaatggtagggacacgatgagcctagccctactatgtattacagagcacacaaaatgagttagaccttggcaggggaaataaactatgtacagacagggaaggggaggaaaaggatgacagaagatgcagagaaattgggaaaggcttcgtagaagagataagtatttgagatagagcttaagagaaagttaaactttccaggagagatggtagtgggagagtccaagctaaaagaagaatctgataaaggatagaggtacaaaagtgaagaacatgcctggggaaccacaaaggcctcttttcctttctatttttagctgagtgcatgatggagaaagtagagaaattggagcccaattgtagagggccctgactaccat

SEQ ID NO: 91695 - DNA, 396 bp, Homo sapiens
agagtagattatagatgagtcagtagaggctgagtaccaatgaaaaatattcagcccaccatcaccatctcagttttacagatgagaaaactgaggctcagggagatgatggtagcttgtcctctgtggcacacatgggattggaatcccagcctgtacatctgaaaaaggtggagatagtgatagccctcatttaaataaactgtacttcagcccttactcagcattctccttgggaacaccaagagttggttcaatttggacaatacttaaaaccaaagcaacaccactgggaaatactttaaagtgcatttgtgtgtattgtgtgttgaggcgacataggtggcagggatgattagaatttagcatatattattcgtagatagagttttatag

SEQ ID NO: 91696 - DNA, 457 bp, Homo sapiens
gcaatggtgactcatgcctgtaatcccagcactttgaaaggccaaggctagaggatcgcttgagcccaggggtcaccccattttggatccctggctggtgcctgacacagaagagaggggctcatgagtcagtggctgttatatgtattgtgtatcagtgtgtgtaagtgtgtggcagccgagtgtccctgtttgtcaaatgttgggctattcttttttgtcttttgtttgttgtttttttctgttgttttgttttgtttttagacggattcttgctcttgttgcccaggctagagtgcagtggcatgatctcggcccactgcaaccccgcctcctgggttcaagcgattcttctgcttcagcctcctgagtagctgggattacaggcgcccatcaccatgctcgactaatttttgcatttttagtagagatggggcttcaccatcttggcccggct

SEQ ID NO: 91697 - DNA, 397 bp, Homo sapiens
aattgcttgaacctgggaggcagaggttgcagtgagcttggtgatcatgccactgcactacagcctgggcaacagagcaagactccatctcaaaaaaaaaaaaaaaaaagaaatatataactgcaatgtttagaaagggatatccaataatgcagattgaagataattgcaactttgtactggagtcagaggggaagaaataactttgatatgacatcaaaaactgtctgctaatggaatgtgtgaaggtgaaatcattttcccttagacccttgccattatcacgtgctttaaaaaacaggagatgctctttttaaagcaactgcatttttaaaatacatgcttagtaattaaatataaatttgctgatgcatataatgcattcaaagttggtaag

SEQ ID NO: 91698 - DNA, 299 bp, Homo sapiens
tggaagaaatttctaagcagcaaagaaatgaactgaaactggaacttatatttaaaagggaagcaaagcataaaagtttggaaaatttgcagcctggtcatgtggtaaaaaagaaaaggccattttcagaggaggaattcaagctggctgcataaatttgcataactaagagaaaagcaagtgctgatagccaagacaatgaaaaaaaaaatgccttgaaagcatttcagagacttgcttggcagctccttccatcacaggcctggaggcctaggagggaagaatcatttcctgagcca

SEQ ID NO: 91699 - DNA, 284 bp, Homo sapiens
gtggtgacaaccccctttgcgctgcctggggggaggccgctgcccagttctgtgatgggcggtgacaatttcagattctcttaatctggccgatgctttcggggaggtgaggtcctgtccctgcgtgtggcctcctcagtcttcccttctgtcccggtgtgcagggagcggctcctgtcgccagctcaacaggaccctaggcttgatggtcagaactcctgggactgccctgtgagccccctctaaggtcccagcattcaccctccactgctctggaagtgctg

SEQ ID NO: 91700 - DNA, 635 bp, Homo sapiens
  misc_feature (624)..(625): n is a, c, g, or t
tggaaaaagcacaggacttaaggatggaagtctagagtcatccaggtgatattgctttagtcaatcacttatctggacctcatctgtaatgccctctctagttctccagccccgacagtttaggaatccttatgaatcttcctttacataggatgtattctcaggttaggtatttggtaaaagtctccccttctctctacaaagtcatagaattctcatgagtaggttctttgccttattcaactttaaattccaagagccacagagccaagcacatggtaagcactcaaggtgtttgctgttgctgttgctttgttgtcacggacagtggtgatggtggtagtaatggtgtaaaagttcccctgaggtggtgacttccatgtgggttttattgcagatatgtaacttgctttagttatgcctgactgaggaaaattcagagatgagtgttttgggccagatcttcagaaggcagcctcccatttaacaggcacttatttatcatgctaacactatgtggtttgccataccaacattgaggatcatcttgctcaaggtaagtctgatgaagcctttttgaaaaataacaaaagaggaaaaaaaaaatccctcctggaaaataannaaaaccctgg

SEQ ID NO: 91701 - DNA, 184 bp, Homo sapiens
tgtaaatgcctaatagaagaaaaaggcaaccatactgattctttggatcaggcacaaatgaacacagcaacaccatgccttttctaggaaaaatagtgaattactttgacagcaacagggtattatgaagagagaccacaaagtacatagaacgtgctcaactcttattttacagactagcaca

SEQ ID NO: 91702 - DNA, 394 bp, Homo sapiens
cgagaccatcccagccaacttggcaaaacctttgtctctactaaaagtacaaaagttagctgcgcatagtggcacacgcctgtaatcatgcctggcccccagactacatttctgattttgttgacagttcataatgtggagaaattaattgtctggtgacatctgaaccacttaaaaagagtaaatggtgatacattatgggatgatcacacagttgtggtgaagcacaaatgaacagatttctagccttgttagttcagttctgcatctaaagtgaagaacctgcctttgtggtttctttagactcttcttgatgatacacagtacagcttggaggcctttaagcagaatagagcagagcagggaggcacaggttgttcagaagctttactag

SEQ ID NO: 91703 - DNA, 339 bp, Homo sapiens
ctgttcaggtttaaaagtagcaatctgtcttcaggtgttcttaaccactacagaaccctgtctttgctaccatctcttttctcctttctgcgtttttacctgtgacctagtctgtgatttttatattgatgctgctctctgctctcatctcctttaataagtttgtcctactccctttttccttctagcctatccaaccctgctctttatctactttactgaatttcttggtcctattttctttattatatctcctaaactaacttcagaatacatgtttgtatgtcaaaacaaccgtagaaggggaggcttaatattccaggtttaccttttagcaca

SEQ ID NO: 91704 - DNA, 369 bp, Homo sapiens
gaagtgcagcctcacaactgctggggattttccatcccaccaggatttccgcgggacaccccaagtccagcctttgaggctcctcaggaaccagagtttggcctggagccagttggggcagaggaggggggccaggctgggtggcctaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggt

SEQ ID NO: 91705 - DNA, 491 bp, Homo sapiens
ggaaaatggaagaaaattcagtgttcaaataaagagattaaactaaacttaaaatttgggaacagaaataaaatttgagaataatataagtaactaagaagcactgaaataatttaaatattatagtgtaactatggttattaaaacaaaacaaattcctttttttttttttgacacagtctcactctattggccaggatggattgcaatggcacaatcttggctcattgctatctccacctcctgggttcaagtaattttcctgcctcagcctcccaagtagctgggattacaggcacacaccaccatgcccagctaatttttgtatttttagtagagatgtttcaccatgtcagtcaggctggtgttgaactcctgacctcaggtgatccacccgtcttggcctcccaaaggcctgggattacaggcatgagccaccgtgcctggcctaaaacaaattctaataattgttcttgtaaaagaaatgacat

SEQ ID NO: 91706 - DNA, 281 bp, Homo sapiens
atcactgaggccatgcattacaaatatagaaaaaaataaattaatagatacagacttctaattgcagctccagtatataaggaccataaaagtcatcactctttccatacaacaggaaaaaatatggccaatctgaaaatccatcactttccttggacttctcagacaaccaaggttgtagggaaaatcatcatcctgatatctgaagaacaatatcctgagatactgcaactgagatgtacttaagcagagcagaagctactggagccataaactaatat

SEQ ID NO: 91707 - DNA, 191 bp, Homo sapiens
agccgctgtggtgtgtgtggttttggaggtacccattttggagtgcgatgagtactgtggggtccacggtgagcacgtactgcgcagtgggtgtaatgtggagttcatagtagcctgcagcttgggagaggggtctggacggggtccatgcatttgggagatatcagtgtatagatagtgtttaaaatttt

SEQ ID NO: 91708 - DNA, 551 bp, Homo sapiens
accccgtctctactaaaaacacaaaaattagccaatcttggtggcgggcacctggaatcccagctacttgggaggctgaggcaggagaatcatttgaacctaggaggcagaggttgcagtgagccgagatctcaccactgcactccagcctgcgcaacagagcgagactccatctcaaaaaataataaataagagctaattttattgtgggtgaaaatttttaaacgtctttctctataataaaataatttccttaaattttatatatactttatcatatataatgtgtgaatgattttaaagttctgtgtaaataacaatattggtaaaatgagttacattttcaacttacttaaatatgtaatgtcacctggtgattttatctttattcttcagtgtattttcttccatttacacatttagctagcctccctaaagtgtactctaccaataattgaaatcttgttaaacaaaattaaaaccatttatatattatgctgctttctttaaaatgcaaaataaaaataagattggggacttgagaatcagat

SEQ ID NO: 91709 - DNA, 814 bp, Homo sapiens
tccttctgctaagtaaaaacgaaaactctagatattatatatgaaacaaacataagaagactctaaaaagtaaagagaaaaagacagactggttagacatctcaagacccaagaagcaataggatggtcagttcttttggacttatatattccagagttagagctaaagaaggtggcaatctggaaaccctaataggccatggacaatgaaagctccaagaacaccaaaagacaaggaaaggggcagcctcacaagacaaaaatattttagacaataactgctgtactctagccaaacaccactgaaaaactgtgaactcacccccagtcactctaaagccaagttgggagcctagacttctacccttgtcagggtataatgagacactccaacccccctgacagggtgttcagagaaggccaaataaagaactaggactttcatctctgccaggctgagaccacatagggaggctggaattttccctctactcagtagtagcaaggcccccttctgtgatgtcggtgccacatgaggaataggacaaagattttttgccccttccattcagggcaattttaagtggagacctactgggaagccagaactcccactcctacctagtgatgagtggtttcctcctctccagaaggtctaacataggccaaatggggaacctagacttctactctaacctgccagtacaggggtggctgtattgaagcagagttagatgaagccagctaaaacagaaggtttaaataaggtccagagtcacataacataatacccaaattgtgtaagcttcaaaaa

SEQ ID NO: 91710 - DNA, 767 bp, Homo sapiens
gacatgctagtgctcggcccacccttctgtttttgtagccaaggcttgattggattttctgtatgtataatgggctgtttcaaaatggtcttgcctcattgtttcttcatatcttattgaaaccaacccactgttgatctcaatctgtgtaaggagaatgcggagtatggcattcgcaggactgaatccctagattttaagtttggaaggagatccaaccgggcagatgaattgaccggtggtgaatattctgtagcattttcctccctggagaggaatgccgccaccgctgggaaccgtggactggcatgtgagccagtggctgtgaaaggcgctgtgccctgtgtcctccgtgtactttagagcaggagcgtcacacatggtggagccgggtgatatcccgggcaggctcccgaaagctcctggtggcccatcaggggctggtttttccaccttttttttttttttttttttcctcgagacaaggtctcactctgtcacccaggcaggagtgcagtggcatgatcttgactcactgcaacctttgcctcctgggttcaagcaattctcgtgccttagcctcccgagtagctggcattacaggcactcgtcaccatgcccggctcgtttttttttttttgtatttttagtagagacagggtttcaccatgttggccaggctggtcttgaactcctgaccccaaaatgatctgcccgcctcagcctcccagaatgctgggattacaagcacgagccaccgtgccagg

SEQ ID NO: 91711 - DNA, 649 bp, Homo sapiens
ctgtgtcccaacaatggatgaatttctagatacacactgctcaccaagacttactcatgaagaagtagaaacactaagacgagtaacaaataaggagattgaattagttatcaaataactactaacaaaaacaagtaatgaaccagatgacttcactgtaaaacgctatcaaatactgaaaaaggatttaacaccaacactcttaaaaatgttccatgtgatggacaaaacactccctctctcattcaataaggctagtgtcaccttgacagaaaaggcacacaaaggctctaagaaaactacagagcaatattcctcatcaatctaatgcaaatatccacaacaaaatgctagcaagcaagttcagcagtatattaaaatggaccacacactatgatcatgtgaaagtcactcctggaatgcaacgatgttgcaacttaggaacattgatccctgcaatactccacaaaaacagaataaaaacaaaaacccacttgataggctcatcagatgcagaaaaaacatttgaaaaacatcaacaactactgatgatagaaacactctacacattaggaatacgaggaatctactttacatacagaagccttatataaaaagccaaaaggtaacatcatactcagtgttgaaa

SEQ ID NO: 91712 - DNA, 492 bp, Homo sapiens
agaaaaagtatttagtgataactagttcacttgaagtctcagctataccaaaacctcctaaattaaaaacaggatttcagttctgataataactctgtcctttaccagataaagtagtatttctccttcagtgacatgagactatgggtataaattgagttgggatagatgaatagttgtcatcattatagttatggtgcattaaaatccacatggcagcaagtagtagctgaggcagcagttcaattgaggttgtacaaataaatctactgcattgctatagtatcatactttactggagggaacatttgctgaattgtgccctagtcagtgacacttaactgaataaattttttttttaaattggctgggcaccatgtctgacgcctgaaatctgtaatcccagcactttgggaggctgaggtgggaggattgcttgagccctggagttcaagaccagcccaggcgacatagtgagaccccatctctgta

SEQ ID NO: 91713 - DNA, 916 bp, Homo sapiens
tatcaaaggagatagatgtacataaggggaattatggagaagtgaaaatttgtctaaggttcattttttcagtagcttaattttaatagtaaactcttttaaggaatgaatggccacaggcagagactaatggtgtactttcagtgttctcagtgagtgcttcacagattaggtttccaagagaagaagattgcctctgaggaagaagagatggggtagcaagaggcatatatgagaccgttcttgggaccaacacctatggaggggagggaagaaggcagaattatgggaccagatagaagaagttggtctgcaatgcagtcttgaggaaggcctcagcagagccaatagacagttccgaagctggcatgcccttgagagttgtcctaaattcgggtgagagggttaggcctttatatccttggtcacttgatagtagatgctggaacaaaatggtgctctttagctaaggcaatttacagagggctgacagctgagagcacttgtagaatctaggaaaatgagtctttcattcttgaaggggaatcttcacatcatccactacaaatggtgctatattttgggaccagcagacactgagaaatgccaggtggatagaatccttccttcttttattctatctttttttctttctttctgtctcctaatctagtgcttctccaaaaatacttttaagaattagaattaggccattagttattataaggaaggaagggaaataatcattttcataaaactcagcaattcttttaatgtcaagatatggattattattacactcaacaattataattattaatattttccacggaaaagtttcatatattgaatgacccaagtactccatgtgaccttccctgtctatgtaacctagcatctgtcagcacctaaaatt

SEQ ID NO: 91714 - DNA, 357 bp, Homo sapiens
ggatctgcttatgagtcttagatgcaaaactgacatatctttaattgggtgtgccatcgtatctgtcctcaggcttgttagctaagcccagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaa

SEQ ID NO: 91715 - DNA, 509 bp, Homo sapiens
gtaatcccagcactttgagagactgaggcaggcagatcacttgaggtcaggagttcgagaccagcctggccaacatggtaaaacccgtctctgctaaatatacaaaattagccaggtgtggttgttgaggtgatcagaaccaacatcgggtgtgggggtgacaaagtctggcagagtcaaaggattgagaaaaagacagtttaagaagtaaagtaggaccaaggggctatcatgatggtggaggctgcaaaggccctgaactctgggggcccatggtattttttggtaatccaacaaagaaacaggtggtgagaaggtggaggtcaaaaggtcacgttgcatcaagtacatgatttacagctgtgatagtttagcatttgctctgctgcttgagataatggagagcaggttcttttaactcaagatacaatcaatcctaggagagcaaggagcaaggagccagcaagtctagacacattccagagccacgagccctggattctatccaa

SEQ ID NO: 91716 - DNA, 339 bp, Homo sapiens
aagttgtaaatgacgttttggttttatgaaaatagttttgatttcccggatcccctgaaagtgtctcagaccccacagacgtcctcagactacactttgagaccaccgtttttgtttttgtttttgtttggagacggagtttcgctcttgtcgcccaagctggagcgcaatggcacgatctcggctcactacagcctccacctcccgggttcaagtgattctcctacctcagcctcccgagcagctggaattacagtcatgcgtcaccatgcccagctagtatttgtatgtttagcagagacggggtttcaccatgtcggtcaggctggtctcgaactc

SEQ ID NO: 91717 - DNA, 367 bp, Homo sapiens
caagggcccacaggcccaccacaggattggtgaccagcattgaggggacactgagaaaagttcttcaggctgtttcttcccagccccgccacaggctatgctggcacctgagagagttcttatcccaccctgtgcggaactcctgctgagcagagtggctttgtattcttccttccaactcaggctgttggtgcactgctagagggctgctgtctctgacactgcagtagccacagtcgagcttgagctggctggtccagcaggggctgctccgcagccctggggctcagaccagagcaatgctgtgagagtcctggtactggccagtgcagagactgcacatagcaagggctcaatgaagtttacc

SEQ ID NO: 91718 - DNA, 1703 bp, Homo sapiens
gaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctccagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 91719 - DNA, 2101 bp, Homo sapiens
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccgctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccgcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 91720 - DNA, 1608 bp, Homo sapiens
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 91721 - DNA, 519 bp, Homo sapiens
gaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgttttaag

SEQ ID NO: 91722 - DNA, 797 bp, Homo sapiens
  misc_feature (682)..(682): n is a, c, g, or t
  misc_feature (715)..(715): n is a, c, g, or t
aatagtagaaaccacaacgtttatttatatttctagtaccttattgtcacacttttggtttgcttgggaaaactaactggggtcatttttttttccaagtagaggaagaaattctattaatacttggggatctgaagttctctttaaagtatttgtaaaaaatcttttcttggcagggactgagctgtcaacatgtgaatgtcttttttttgcagtctcactgttagaaaccaggaagatcagaggcccacaatagcttcccacgaactcagagcagatcttccaacctgggaagaaagtccatcgatttccacattcattacagacaacaaatgttgtcattggttcatcagcactacgggtttgtacctgtgtgtaagtgcaattcttctttttacatttgccacatgtgaacaagtcagtctgggtcccaccagtcttggccatctgatgctctctgatggcttctttggtcaagtttttccgcatctctttcagctcatcactagccatttcctctgctgtcattctagcaaataagtcaggacgaatattcccacagaggacattttcccttaaatcaggattttctgcatctttacgacttgatatgctactccgtactctattgttgcatctcatgtctgtattccttatttcttgatatatagctccttcaatntgagatcctaattcttcctcatcagctccaatnggcatgtagtcatcccctgggtcgagagctgcagcaggcattcttctacacttcacctgacagaatcagagtgcttggtgcc

SEQ ID NO: 91723 - DNA, 496 bp, Homo sapiens
attaaaatgtccagtcatctaatgcacttgacagttcgggacagaagcattaaagtggcttcacaggagatcctattcctcactccacgttggacattgttatgggttgaattgtgtccccccagaatatatgttgaagttctaaccatgatacctgtgaatatcaccttatttggaaacagggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgtttta

SEQ ID NO: 91724 - DNA, 1757 bp, Homo sapiens
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 91725 - DNA, 1524 bp, Homo sapiens
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 91726 - DNA, 1554 bp, Homo sapiens
gaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctctctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 91727 - DNA, 167 bp, Homo sapiens
accagtagaagagccacctggctgagctcagcccaatttgctgacccatagaattgtgaacaaataaaatggttgtagttataagccattaagtttcagagtttgttacacggtaacatgtaactgatacaactcttggagccagttgttcagccattctcaaccac

SEQ ID NO: 91728 - DNA, 1068 bp, Homo sapiens
  misc_feature (55)..(58): n is a, c, g, or t
gcttaacgcgcaggaggtctcacgagagtggaagcaactctcgcgaattttaaannnnatcttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggtcctaagggagggcatgccacaggctccaggccacagaggcaaagacatggaccctgttccacctgcccctgcaagtctcaagtgccaccagaccccttctcatgtacttgagagggtgggatggtacagagagagccagaagcacagaaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaatttagcgccaatctcaaatgaagtaagctaatatggaaaaacccagacctagggctgagaattataaaggctagcccgagggaaacgccccataatataaagcgagaaatgagacccaattgg

SEQ ID NO: 91729 - DNA, 1338 bp, Homo sapiens
  misc_feature (55)..(58): n is a, c, g, or t
gcttaacgcgcaggaggtctcacgagagtggaagcaactctcgcgaattttaaannnnatcttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagctggagagtacatgagatgatctgtgccattctagacatccctgtctacaagagtcggatccagtcctccatctgctctttttcctctaatcaagaattcagaactcacaggatttaaagtctcgtgaggagaagatcatctttatccatgcactccagtgaaatgggaattactcagtgagacctccagtgtgttaggtggatggcccgccagcatgcagtgtgagatgagcggcagccgtgtcggggttgtggctctgaagaaatataacggatgcggagatcggaaatatgcctgaattg

SEQ ID NO: 91730 - DNA, 1491 bp, Homo sapiens
  misc_feature (55)..(58): n is a, c, g, or t
gcttaacgcgcaggaggtctcacgagagtggaagcaactctcgcgaattttaaannnnatcttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggtcctaagggagggcatgccacaggctccaggccacagaggcaaagacatggaccctgttccacctgcccctgcaagtctcaagtgccaccagaccccttctcatgtacttgagagggtgggatggtacagagagagccagaagcacagaaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagctggagagtacatgagatgatctgtgccattctagacatccctgtctacaagagtcggatccagtcctccatctgctctttttcctctaatcaagaattcagaactcacaggatttaaagtctcgtgaggagaagatcatctttatccatgcactccagtgaaatgggaattactcagtgagacctccagtgtgttaggtggatggcccgccagcatgcagtgtgagatgagcggcagccgtgtcggggttgtggctctgaagaaatataacggatgcggagatcggaaatatgcctgaattg

SEQ ID NO: 91731 - DNA, 505 bp, Homo sapiens
gggggtagctcaaacgggtcagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgatacggttttgaggggatcctcta

SEQ ID NO: 91732 - DNA, 3123 bp, Homo sapiens
cactccatctgagggtggctgcgtgtccacatacgaggggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttaaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagacacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaaaaaaat

SEQ ID NO: 91733 - DNA, 3240 bp, Homo sapiens
cactccatctgagggtggctgcgtgtccacatacgaggggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttaaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagacacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgatacggttttgaggggatcctcta

SEQ ID NO: 91734 - DNA, 1707 bp, Homo sapiens
tgggtgatctacaggatcctgtgtcatcaaaccctcatcaatacatggagatttacagaaatagtcaaaccacatctacaaaatgccagtatcaggcggcggcttcgaagccaaagtgatgtttggatgtaaagtgaaatattagtttggcggatgaagcagatagtgaggagggtttcgatgagtcatcaaaccctgttcgtggggaacctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagacacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaaaaaaat

SEQ ID NO: 91735 - DNA, 576 bp, Homo sapiens
gggggtagctcaaacgggtcagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaaaaaaat

SEQ ID NO: 91736 - DNA, 521 bp, Homo sapiens
cactccatctgagggtggctgcgtgtccacatacgaggggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggtaagcgctgttcctttgtactctacccaagtagtccctctctgtgtgtttaaaggggatatgctttctagccgctcaaaaaaaaaaa

SEQ ID NO: 91737 - DNA, 496 bp, Homo sapiens
ccagtcactttgtaggaacatcccctgcctgttttcccaggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggtaagagtcttgagggccctgtgtatgatccatcactggtgccgtgtgctgatctgtagacatgggctggacctggcttctatccccaccccacccgcagtgattccctgtgctccagtgagtcttatccttgttcaggtgggagcagctggaagtcatggtgccccttgaaaaagaccattcttttcaccaaatacaatgagatattaatatgtttaattttccagcagaaaatatgttatctgtatgcagcataaaatcacaacca

SEQ ID NO: 91738 - DNA, 3311 bp, Homo sapiens
cactccatctgagggtggctgcgtgtccacatacgaggggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttaaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagacacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaaaaaaat

SEQ ID NO: 91739 - DNA, 3094 bp, Homo sapiens
atcccccgcgcggagagcgctggtcgagcatttaattgtcagcctgtttggaagcatctgaaacgcatgtcatacgggagagccttggcctaacgcagagcaacctcctaagggacaggaagggctcgagtgaggctgagtcctgagaatgtcctatgaaggatgaatctgtgagaagtgtgcatggtaacacagaggagcagtgccaaggcacactgttacggggtgagtgtgtacaggctctttcctgcactgattcatcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttaaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagacacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccaccaaaaaaaat

SEQ ID NO: 91740 - DNA, 1282 bp, Homo sapiens
cactccatctgagggtggctgcgtgtccacatacgaggggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagataggcagaaaatatgttatctgtatgcagcataaaatcacaaccacaggagcaagcatccatgaagaatccaa

SEQ ID NO: 91741 - DNA, 396 bp, Homo sapiens
acatcctggtgccctggatagctgggaggctgaggtctggaccaagacatacaccatggtgccctaggagccctgcaaacatcatatggggaactcactcaatcttggggttgtgacattatcactaggccttgaaggctgaaagagatcatctcttattggtgatttggggagttggggggcagttggaaagggaatttcaggcagaatgaataaccctttggaaagacaggtgatgtgctcagcaaaatttaatactacttttggtgcctggtgctcttgagagaagaaaaggagaacctgctcttccctcagttctgtgctctgccagagcatcattgccagggatactggtacatgccaaaggcttaccagaagtcagtgtttcattccctt

SEQ ID NO: 91742 - DNA, 1749 bp, Homo sapiens
gggctgccaccccacttctccccacagagaatggggaaggaaggctgcgggtcatcgtgggaagggaggctgactcctcctctgaggcctgtgttggcctggagcctccccaggatgttacagaaacttcgtggcaaattgagatcaatgaggccaaaaggaaactgatggagaatattctgctctacaaagaggaaaaagtggacagcattgagctctttggcccctgatgaccggaacacagctgaggacccttgtcctcagttggaaagatgagcatcagatcaagaaaaaggtctgaggcagaatccaagatctgccaggaaacacacaacaaaacatctgctgtcctgggtgggagggaaacttcatttcactggaatgagttgggagagaaaggccctcagcttttagagacacaaaaatccatgaagtctcttcctttctgggctttgttagtcagagcaggggatcagaggagactgaagcagaaaccctgcacacgggcccaggatgtggctgattttgtggttccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtcgaca

SEQ ID NO: 91743 - DNA, 1913 bp, Homo sapiens
gaattcagttatagaaaaaaaaggcaagcttggtttatttctctttatttggtttattctcattattatttttcttgccttttctacctctaattccttcttagcccttccctttctgcttccatttctatcccaaaatatgagccacaaagagaaatttggggaattagaaggaagagacttaagggaaaatgtatatgtcattggtgtatgtgtcagttttcagtcataacttgggttgggggaagtcagtgtaccctttactcttgctgaggaaatttcttctgagccttagccacatcccacttgcccagggcatcattcttttcttttttttttctggcatatatctctacttcagattcaaacttggccattacctctggccagccaagcagctgtcccctgagaggggggccaactctcctgcccctcactgcctgcctcccaaggctgccctagggctcagctgaagaaggcggttgtgctttgctgccccctgttgctcaagtcctgcttttccataggagctgccgggctgtatgtctggatgtgacttctccaggcaggtcctcctctcctgcccgcagtgctctggctcctcagggtaggtttctgtccaggacatggcccctgaaagggcttggaaaaagcccccttgcgtagtactggctgagcttctacttgctgccccaggaacctccagagagtgacccaaacatctggtatagcctctaatcttacctagtcagtcatgtttctcttcaggcctcttctaagaacagtttcctggagaaacagaatagagttgtggtcactacactggagtcttcctggggtaggagtgggtcctttctaaagtagaaggggctgtgtagcaagggggctgtgtgagcatttctagaaatgttgtctgctgaattttccactgggaaagagcaagtcctggcggagttagcagcagctgggcagtaggcaatagatagcatcagggtctctggatgctcagtgggggtggcatcagggaacactggtttccccagtaacgggcgcctgggcctgcagtggcagtcaattccacagaggatgccccggagcttggcatctctcactgtgctgtcttcccattcctgagactggaatatggagctcatgtgggctgggcagcttcccagcagtggttggtcaggatgtgagagtgctgtggtccaggtacctgtggacaagtgacctgccacactgcaagacccaaaatgacactggactacattcgttgacacagttacagctgtaccaaaattttttttccaaggttcaagttggaacatttgtaagccaagccctcatgggtccaagcctattttcttcaccacaccacactgagtgagggcagtggctcattacagaccacagtatctccccacctccacccatgtagatgagaacctggagcctgccaaggactagtgtccagaatggtgcccaagtcacctcctgataggtaggaagtggccaaaatgaggtgtaggacctcatgtcctagaggtcaaagctaagagtccaaggcaaatggccacaaggcagaaagagccaaaccagagcccccctaaaatggggagaccaggatggatagataagaagaagggcaggctttggctgggcgtggtggctcacacctgtaatcccagccctttgggaggccaaggggggtggatcacgaggtcaggagatcaagaccatcctggctaagactgtgaaaccccgtctctactaaaaaatacaaaaaaaattagccgggcatggtggcgggcgcctgtagtcccagctactctggaggcggaggcagaggttgcagtgagccgagatcgtgccactgcactccagcctgggcgacagagcgagactccgtctca

SEQ ID NO: 91744 - DNA, 297 bp, Homo sapiens
gtcagaagaacagaccttgacattgggagaaaaacagaagtcacttttgtcgcattggcaattatttttaattttttagttagtagtaaaaaatcttatttggatatatttaatttgatcatattatcttatagctttttacatagtatatacttacaaaaacagaatttgctttttgcctgactcatctgtcatttctcaattgaaaaaaacacagttgtaacaaaatatgctttatctatttctgattcttatgattagtataagggtggtgtttttaaaattaataaaagtaaa

SEQ ID NO: 91745 - DNA, 5865 bp, Homo sapiens
cggccgtcgacacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcgctgtccccgaccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccggcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatccggaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgacccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcacttcccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcacccctcgggacatgtggccttcctcacctccactgagccgcagtatggccagggcatcctgagccaggacgcgtgggagagcctcttctccagggtgtccgtgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaacgctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacgagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaa

SEQ ID NO: 91746 - DNA, 8065 bp, Homo sapiens
  misc_feature (6519)..(6519): n is a, c, g, or t
cggccgtcgacacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcgctgtccccgaccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccggcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatccggaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgacccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcacttcccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcacccctcgggacatgtggccttcctcacctccactgagccgcagtatggccagggcatcctgagccaggacgcgtgggagagcctcttctccagggtgtccgtgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaacgctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatnctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaa

SEQ ID NO: 91747 - DNA, 8464 bp, Homo sapiens
  misc_feature (6519)..(6519): n is a, c, g, or t
cggccgtcgacacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcgctgtccccgaccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccggcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatccggaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgacccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcacttcccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcacccctcgggacatgtggccttcctcacctccactgagccgcagtatggccagggcatcctgagccaggacgcgtgggagagcctcttctccagggtgtccgtgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaacgctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatnctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagacgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaa

SEQ ID NO: 91748 - DNA, 7136 bp, Homo sapiens
  misc_feature (6519)..(6519): n is a, c, g, or t
cggccgtcgacacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcgctgtccccgaccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccggcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatccggaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgacccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcacttcccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcacccctcgggacatgtggccttcctcacctccactgagccgcagtatggccagggcatcctgagccaggacgcgtgggagagcctcttctccagggtgtccgtgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaacgctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatnctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaa

SEQ ID NO: 91749 - DNA, 556 bp, Homo sapiens
agagagactcaggtattaacttacccgggaatgacaagatgctaagtcagtttagcgagactccccacccttgctatctgaccatcctcaatacggatcaaaccttcatcccccacccttgctatctaatcatcctgaccctccttcagtaaaaatcctaacaactcagtttgggcacaatcaccactaacttctcacatctgacgccctccactgacgcccactctgctcttggccaaattttccgtcttgctcatgctacattcagaactgagcccagttctgcatcaaggttctttccctcattgcaatagccctaaatacaatctggctttaatgctttaactactttctttgacaggggttattatttttttgttgtaaagaattagaactctcaaacaataatactcaggaactgtatggttttgttgaagttttcagtgttcttttataactatttcatttttattctccacaacgcactgcgaggcagtaaaggcaggcatttttaccccctttcttccaggttacaaaattgaggtgcaaagaggcc

SEQ ID NO: 91750 - DNA, 120 bp, Homo sapiens
gcataagcatgtgtgtgctgtcctctacttgccctgtcacctccagcatcttgaacatatggaacatggtcacagcataagcatgtgtgtgctgtcctctacttgccctgtcacctccag

SEQ ID NO: 91751 - DNA, 570 bp, Homo sapiens
cagaagtttcgagttcttagtatgcaggtctgttagtgatcagcaacaggattgcatcatcaggaaaattctcttcatcttttcctcagaatagtaaagtcctaaagctttcccagtccctgtcaaccctttctggattcagacttggctgtggtgttagtgtgggaggctcagccatgtcctgaaaagtgctgccccaggctttgaatccagcttttctctcatttgctttgggatcttgtaggcgttctctgagctggctttcccatctgtaagtggggatgatgccaacttccaaagcctattagaattaaatgtggtgatttgttgtctaagatagggcctggcacagggtaggtacttaaatgggtgcttgctttcatatacaaccactcagtgatcccctgctctctcactggggaaggaactagggatttggtggagcctgaaacatgacagtttcccttcgtgtagttcaagccccatggaggcctcagacaggaggataagttatagcccaggaaggtaactgcagaagcacactgaagggggacatcttttccactttgg

SEQ ID NO: 91752 - DNA, 469 bp, Homo sapiens
aactcgaggtctgatgttcaagggcaggaagtatccagcacgggagaaagatgtagcctgggaggctaagccagtctagccttttcacattcttctgcctgctttttaatctggccactggccgagctggcagctgattagattgtgcccatccagattaagggtgggtctgcctttcccagtccactgactcaaatgtggcaacaccctcacaaacacacgcaggaacaatactttgcctccttcagtgcaatcaagttgacactcagtattaaccatcacaacctccttccttatacaaccttaacattgtacctgcagttaacagttgccctttttctggcccattttttaaagcattctttttgctcctcctccccacatgttccagcactcctgttgtgtgcttcttggtaatactttgaaagtgctcaagttcattgatgagaattttaaaaaggagaagaaa

SEQ ID NO: 91753 - DNA, 783 bp, Homo sapiens
tatacctcataatgcaagaatgattggacaagatccctgtcttatgggagtaacaaggcatttagctggcatgagctgaaactccagaaatgcatgtccaacgagatggaggatatgcttccttccatatcctattctgaagtggatttttataaattatttgttatctctacaattccagaaatgtttatggtagcagtgcctggtctacattgtttattttcaacagagaaatatttttttttcaaagcactatatttctgtaggtgtgttgtcaaaatgctgactcattcactcaagtataaaatttactatatgaattgccttaggagcctgaatattttccaaattccatgtcttaaatcaacatgtgaagatttcagttccataatttctgtgatttagtctcaagaaattcacagtaaaaattcaacattaaagttttggtaacatcacaaaaagaaggaggaagagaaggatgagaaagaggaaaaggataggaaggagaggagaagaggaaatgcaggcaagcaggttggctcacaacacatgaaggtcaactttggacacagactcaaaacccatgagaacatttatgggtacatttagagctttggatttgtaagattagaatttgaagctttactatttcctcctagaaactttgtctacaataaaattaaattgtcaccctatgacagagtcactgagaaggaatgttcaagttttggcttttttggtaggtgtgatttaactcagcggtctccagcctttttggtgcca

SEQ ID NO: 91754 - DNA, 970 bp, Homo sapiens
  misc_feature (880)..(880): n is a, c, g, or t
tctgatttaaatactgcttttattgagtttgaagttaacagttgtttttaaaacattttaatgaaaataattgacatgtttaataattaggtgagttgatctcaccttttaatcaaaagatgagctgtttcccccattacgcctaacgtgtagtactccatcctccaaatagttgtttggattattctaaagcattggagatgaactttctaaaaaatcatctactgcagcaaaataaatctttcctcttcagagctttaccctcgtagcagaaaaggatgtagcctgccttaagatgtattccataagcacagatgctgatttttatgagctatttgtagcttgggctttagaggttccaagagtaggtgcagcatgaaaacaaaaacggaaagctgaggaagacaactggaagataagttatgactagtgggattttctgtttgtgttcctcctataattgcaccttgaatgatttactcttcttaaattggagaccacagtcagcactaataagattttataccggttgcctttgaaaatctaataagcagcaggatatgttaatagtaatatattaattaacattaaatattagcgttaaaattgttagtgtttattatggtaatatggttatatcattaaactatacatgcatacctgcacttcaccatcatgctgattagaagcatctgcagaaacttgtggggggcatagtgagggtaattgtgacagcaatccttttcagaaaatgaaggaaaccagccagtgtggtggctcatacctgtaatcccaaactcctgggctcaagcaatttgcccaactcagcttcccaaaatgctggtactacaggtgtgagccactgtgcccagcctaaagnatcttttcatatgcttgctgtttattttgatttgctgttctgtgaattgcttaggtcatatctttttggcttattttctgttagggcttc

SEQ ID NO: 91755 - DNA, 213 bp, Homo sapiens
tttatatgagtaatagactaatgtaattttaatagcactttgtaatttataaaatgtattcacacacacagtgtttcacttgggttttagaatccctatgtggtagctaaggattacctttttctaagtatatcagtaaagaaatttatgttcaaggaagtgacattcaaggtcacaaaataaatgtcagtatggtagaagggaaaaagctgg

SEQ ID NO: 91756 - DNA, 770 bp, Homo sapiens
ccagactcctgaccacagtcttcctgtcactccttccacatcctcaacaggatcagggaaaaggatgccctggtctgtgtcccactgaaacacatagaatttccaggggtcagtacaaacagtcaagaacagagatttctgtgctctgttcctagttctgagagactatggacacgttcctgtaactattccatgagtcagtgtctataataaaggtgaatggaacaatgtttagaaatagaaaaccatgggaaaacaagagcacctatgccacacatcttggctggcagtgccatcttcggtgtcctaggagtgtgttgatgggaaaagacaaggagggttatggaatgattgaaatgttattatttacttaggttttactaaattaataaacccacctttcaggcatgtaaggtgagaattattgctagcttttgtaatgtgctctatagagtaagatggagttgaaataataaatagtatagcaacccatagtaaaatgcaaatgttagtatttagggaatttgaaaaagtgaatacagtttactctctttttagtgtactttcttcactcagaaaaaatgactttgagccttgtccaaagtctcagacatttatcagatgtatttaattcctctggatgccgaagatgctttttaaaaaatgtctacaacagatgttaaaatgctgtcagctgaatgattcgctgctgggacatcagagagtaataccctgctgatctgtggcaattacctaggtagggaacaatg

SEQ ID NO: 91757 - DNA, 452 bp, Homo sapiens
cttaaccccatgctgaaacaaaatacaactaattctccaggtgacgttcaaatgctccaccaggaaagggaaaaaagcagtagctgcagataatttattatgtatataataatacgtccaatgcacttaaactcttaatttttatactatctacactgttaggtaaacaatattagctcctatcttaaaatgagagaaagggatgcagggaataacagctggaatttgaaccacatctgactccaaaaatgttctcttaacacaactctgctgccttgacaagatggcagatagatacaatgccgtctagtgtagctatgtggctacctgatctctgctgaagaaaactaaatgacagcaccatacccaaccctagaacctacaaaatgtccccttacaaaacagacacttaacaggaaattctttttccaaagaaattgtagtggtatcag

SEQ ID NO: 91758 - DNA, 301 bp, Homo sapiens
tcagtttacatataatccttttttcagccagctgaaattatatgcagtaacactgggatatgaacatgaatagtaagaacttggtcctttgatcctagaggaactcagaaccagatgggaaagcacaatgaggcaggtgtgaaatgaggacatgacccaagtcagttgtcatggtgagaaaaattgataggccaggcatggtggctcatgcttgtaatcccaacagtttgggaggccaaggcgggaggattgtttgagctcaggagttcaagaccagcctgggcaacatagcaagaccttg

SEQ ID NO: 91759 - DNA, 928 bp, Homo sapiens
gctgttccttcactgagacatcagattctgtcagttcttccctttgcatctattcctttcccatttcattgttatcatccatttcaggccttttctgcccctctttttccttggtgggttgtagtagcttaactggctttctggcctctagtttctgccctgcctctcctcccgatctccccccaagctactcacaagagcctggtcctgaagcacagccacaacactcccctgttcaagtacctttaatgacacctattggttaatgcattcacaattcctagttggcattcaagactgtatcatttggcactgaatgttctccagttttgatgcctgtatatagaccagttctaactcagttggacttgatgcttttccctgaatatgctccaagtttctccatctcctactagtcctcctatctcaaatgcctcctctccatctcttttattgaaatgccacatcattcaaggacttgcttagatgctttttctcaagagtctcttgactgccagggataaaagggaccccttcctcctcaaattaccaaaatatcttctttttgcatttatcacgtggttatttctgcatatcttctttcctcaacagagtctgagagcgaagagaccagatttttgtggcagctgaattctccattctctctagcacagtcatacttctagtatgctgtacagcattcacagaacaccttcaagtttacaaagcatgttcacattcaacatctcattcgttttatttggggattaagttattacaggtagtattcaagtcttgcgatttgatttctgtggcttactgcaattcttagagctatctctaattttctaccttataaattaaacaaacatatttcttaaattactttacttttgaatacccacagtcttctgtggcctacaaagct

SEQ ID NO: 91760 - DNA, 1896 bp, Homo sapiens
  misc_feature (1)..(3): n is a, c, g, or t
nnngagagaacccaaaatagcattgagtaagcagtgacatactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatgatatagggatgctgtattccttgaagattacatttcaaagagatggtcaccattacttgataaatacaatcctggatcctaaagcttccaagaaacttgttgaacttttgaaagatttccatacgcttcaaagggacaaagaaaaaacttacatacaaagctttttttttccctctctctctctctttctctgtgtgtgtgtgtgtgtgtgtgtgtgtgtgtatgaatgctctgagaaaaggaaggaaagaaaaaatattttcccttgctttcaacaagtacaaggcctctaatttttaatttgttttgttctttcaaattatcattgcaaatagtacatatattttaaataaaaacactaaaacaaact

SEQ ID NO: 91761 - DNA, 3361 bp, Homo sapiens
  misc_feature (1)..(3): n is a, c, g, or t
nnngagagaacccaaaatagcattgagtaagcagtgacatactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaacgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacacttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaaaaaaaaaaaaaaaaaaaaaagaatgctaggtaatcttagtagaaaactagaaagtatgataaacaacagttggaggaatccatggaaaatagacgagaaaatgtaaataaggctttctggggatcacagaacttttgtatgaataaaagccttataaaaccagctctggcatatgactaaaatattcctctactatttttcaatgtcatctaatgcaaacgctcaacctttttaaatggttaatgtgagaaaggcactg

SEQ ID NO: 91762 - DNA, 3415 bp, Homo sapiens
  misc_feature (1)..(3): n is a, c, g, or t
nnngagagaacccaaaatagcattgagtaagcagtgacatactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacacttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaaaaaaaaaaaaaaaaaaaaaagaatgctaggtaatcttagtagaaaactagaaagtatgataaacaacagttggaggaatccatggaaaatagacgagaaaatgtaaataaggctttctggggatcacagaacttttgtatgaataaaagccttataaaaccagctctggcatatgactaaaatattcctctactatttttcaatgtcatctaatgcaaacgctcaacctttttaaatggttaatgtgagaaaggcactg

SEQ ID NO: 91763 - DNA, 3269 bp, Homo sapiens
  misc_feature (1)..(3): n is a, c, g, or t
nnngagagaacccaaaatagcattgagtaagcagtgacatactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacacttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaaaaaaaaaaaaaaaaaaaaaagaatgctaggtaatcttagtagaaaactagaaagtatgataaacaacagttggaggaatccatggaaaatagacgagaaaatgtaaataaggctttctggggatcacagaacttttgtatgaataaaagccttataaaaccagctctggcatatgactaaaatattcctctactatttttcaatgtcatctaatgcaaacgctcaacctttttaaatggttaatgtgagaaaggcactg

SEQ ID NO: 91764 - DNA, 366 bp, Homo sapiens
aattaacaagtcctctattactaaatagcctggcctagaacagtggtttgtgatcccaccggcttgtttgtgcttggcttttttaaccccagtgtgaaataatcttatagtgcccctaaaggatgattctattctgtcctttgcctaatgttaataattatattagagctagcacacagcagagcctagtctgtcaaaccttccaagtctgtactactcttaattgggggccttctcaccagtcaacagacagaaaaacttcctacaactgcttcggacagtccctgttatgcaacccctcagcattccacaggatttgctgatagtgcaggagatgcaccattgctgatggtgccttctcattgt

SEQ ID NO: 91765 - DNA, 486 bp, Homo sapiens
gctccttgcagagcagggctgtgccataggcagtatgcctagagtagtagcctgttgaagagattttcttttctctattggattgtgttgatatttttatgaaaattacatgattcgtgtgtatgtatatatgcagtcagtcctctgcatctgtgcattcaaacaactgtggatcaaaagtatctgcgggaggaggatggggggaaattgcatctatactaaatttgtacagatttttttggtcattactccttaaacaatacagtacaactatttacatagtattagttattattagtaatctggagatgatttaaggtatgtgggaggatgtgcacaggttgtatgcaaatgctacaccatttcctgtaggattactgagcatctgcagattctggtatctgagggaggtcctggaaccaatcccccatggataccgagggatgactatatacatacatgcacatacacacacacacacacaca

SEQ ID NO: 91766 - DNA, 475 bp, Homo sapiens
atgaaattaagaatctggggtgtgcaagcactcatgcatatgtgtcttcattttgaaaagcaagaccttaattagccaagaaaactggtattttggactcacctattaatcaattgtcagggcaaagtaccagctgcaatctctctcaattatattgaaaaattatatggactttatggtcagctgtgccctaagcactttgtatacattatctcatttattatttaaaacaacactgtcttatttaagggcttgtgtttttgatggctcatcttgtctactgatgccacaatagctggcttagcagcggagtgggaggtgttatggcagatacatagggacagagaaagagcttacaattcttctaccaacccatgttagccttgtgcaaccactgagctgggaagacaaacagataaagggatataaagacggatgtaccgaggcaggagatgggcagggcttgtgttctggt

SEQ ID NO: 91767 - DNA, 307 bp, Homo sapiens
  misc_feature (1)..(1): n is a, c, g, or t
  misc_feature (167)..(167): n is a, c, g, or t
  misc_feature (171)..(171): n is a, c, g, or t
  misc_feature (187)..(187): n is a, c, g, or t
  misc_feature (198)..(198): n is a, c, g, or t
  misc_feature (202)..(202): n is a, c, g, or t
  misc_feature (288)..(288): n is a, c, g, or t
  misc_feature (306)..(307): n is a, c, g, or t
naactgacacacaatggagtaacatgcagctattcaaaagaatggggacagtatctatgtagtaatatggaaaattcatctgagtgtattgcaaagtgaaaacaggaaagcgtagaagagttataatatgctaccttttgtgtaagggaagaaaatatgaacctctntatntttcatatatctgcancagagcgaaanacangagaatgtacaaaactaataaagtagttaccttataggaaatgcattgggatatatgtaagggaaagagaccttctttgtgtatanctttcataccatcatgcnn

SEQ ID NO: 91768 - DNA, 313 bp, Homo sapiens
acactgtcctgggtgctgggaattcatgagtgaacaaaacaatgtcctgacctcatgcagctcacattctcataggagaggcagaccatacacaaatagacaagtaaacttacactataatgtcaggtagtagtaagtactagtggaaaaaaatgaagcactgtgtcaccagacatttgcacatgtgggatgtggtttgcctgggaagccttattcagcaagcctgagatttgctaatttaagtgtttcacaataaaataagagctttttagaaaaataatattttttatttgagacagagtttcactcttgt

SEQ ID NO: 91769 - DNA, 412 bp, Homo sapiens
attaactaaaaatgataatgcattataacttccaggtaagagataatatgactgcacctcctgaatccctcaatcctaattactcataaagtgagaaacagaatttaaaaattggaaaatcaagcataaggaatggaagccacagaaggatgacacctacacgtcaaaaatttctgggctttcaacccatatttctatgagatgtatcacagataggaatatggaataaagggataaataatgtcttctcaaatatacttgtgaagaaagactgaaaagccaagagagtggcaggagtatcccactactgccccacaatgagagagaaagctggtgaactgaatgaagcgacaacacttgtcagaagctgtggaagattttcttggcttcaggactaatctgagaagggtgt

SEQ ID NO: 91770 - DNA, 374 bp, Homo sapiens
cgctcgcgggcttcagcgaggcgggagggcggccctgttgccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaag

SEQ ID NO: 91771 - DNA, 938 bp, Homo sapiens
ggacgcgtgggtcgacccacgcgtcgcggacgcgtggctctccggggagcggaagcgccttcaatgcaggcctgtgggcaggggcgtgggggcgcgcacacacacacgcctgggtgacctctacgtatatacagagcctccctggccctcctggaaagagtcctggaaagacaaccttcaggtccagccctggagctggaggagtggagccccactctgaagacgcagcctttctccaggttctgtctctcccattctgattcttgacaccagatgcaggatggtgtcctctccctgcacgccggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaacggttcgtctggaactcgttgctggagccttgagtgtgtatggacgtgtgcgtttttcgcctttgtgatacgctggcaggtgctctggggcgtatgtataaaagcgccggggcgtttggacctgggaagtagaggaattaatagcggggggacaaggcgggaagtaaaagagggagaagaaaaacgcggtggggggagaaaacgggggcagagaacagacacgaggagaaataagtagaaacaaggggggatagtcagagtaggataattc

SEQ ID NO: 91772 - DNA, 448 bp, Homo sapiens
cgctcgcgggcttcagcgaggcgggagggcggccctgttgccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggcgggtagaggacgggctgtggcggggcgacctcgagcgcgctggtctgaggggcggagctcgcctgggacctgggccacggaaggagcgcgggggacgcgcggggtccgcggggcgggaggcgggaggccgcgaggcgggcgggcggccctgctgtgacgtccgggcgcccctcccgctgcaggggccgcaggggaccccacccgct

SEQ ID NO: 91773 - DNA, 470 bp, Homo sapiens
tcctttgggtcacacatcctagcatcttgctcctctgatactcagaaaattgcaaatggagcagtaacggtcaccctcatgagcccagtcccatgacccggtcaggggagaccccagttttctactggggttgcctgtttggctttccttacttatcgcctgacccctggtctccttattttttgggataggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaactcaagtccaggagcctcaggccccgcgtcta

SEQ ID NO: 91774 - DNA, 802 bp, Homo sapiens
ttattttattttattttattttgtgaaagcgtgcagaacaaaattaacaacaagtatatattttgttttgggggagaggggagtatgagaagctcattattggatgtattgagttgcctaataaacattcatatggagcatgagttggaatgtgttgaagttcagtgcaggtccaggttgaagatacacatgtggcctatgatttgtcttaatttgtttatattttataataaaaaatatgaaaaagaaggattaagtggtactaatgacaaaaagatgggagaagttgcggtatgaaggtaagctggggttgtggagtcaccgactggatgttcacaaattgttccattcaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactgaaataaaaaaaaaaactctcccgcgct

SEQ ID NO: 91775 - DNA, 2005 bp, Homo sapiens
ggacgcgtgggtcgacccacgcgtcgcggacgcgtggctctccggggagcggaagcgccttcaatgcaggcctgtgggcaggggcgtgggggcgcgcacacacacacgcctgggtgacctctacgtatatacagagcctccctggccctcctggaaagagtcctggaaagacaaccttcaggtccagccctggagctggaggagtggagccccactctgaagacgcagcctttctccaggttctgtctctcccattctgattcttgacaccagatgcaggatggtgtcctctccctgcacgccggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtactcactgcagctatcctcatctccttgatgggctggagatacggctgcttcagtaagagtgggctctgtcgaagcgtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggtacgaattataaacaaacttcccctttaggtatccctggagtaataatgacaacaaaattcactgcaggtcggtggaatgatagaatgcattttaaatcacattgtaaacttccaggtgatccatggataggataaataactaagttattataattgtttaggaatttatagtccataaaatatcctccagccaggtctcatttcagcttcttgacaatcccataaagttggccatttgttacacatagagaagttgaggctcacagagggtaacaggcttgctgtaaaagcacacagtgaagttaaggtgaagtcagcacctgaccccctatctccctgttgttttgttgttgctgagacagggtcttgctctgttcccctgtctggagtacagtggcacaatcatagcttactgtaacctacaacccatgcactcaagcgatcctcctgccttagcctccgagtagctgggactacaggcacacaccactacacctggctaatttttaaattttctgtagagagggagtctcgctatattgcccagtctggtcttgaactcctgacctcaagtgatcctcccaccttggtctcccaaagcgctggattacaggcatgagtcactgtgcctggccccaacccccatcttctaaattcaacttctccagttattgtggactaaatagtgtttcctccaaatcttacagtaaagccctaacccccaatatgacagtctttggtggtggcactttttttttttttttttgagacagtctcgctctgtcacccaggctggagtgcagtggcgtgatctcggctcactgcaacctccacctcccaggttcaagtgattctcctgcctcagcctcctgagtagctgggatacagggcatgtgccaccacacccagctaatttttgtatttctagtagagacgggggtttcaccatgttggccaggctggtctcgaactcctggctgcaagtgatccgcccaccttggcctccaaaagtgctgggat

SEQ ID NO: 91776 - DNA, 701 bp, Homo sapiens
cgctcgcgggcttcagcgaggcgggagggcggccctgttgccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagaaggcacgcgcgccgggcccccacctaaataatcttccccccccttcttttcaatacgcc

SEQ ID NO: 91777 - DNA, 473 bp, Homo sapiens
cctggctggtcacctctagttgcaagcagcttcatctgactctagtttctccggtttacccagtatactctctggtacaaatacaatactctgtgggtacctacctgtgaaaggtttggaagtacagatctatgagaatgtattaaggaacactgtttctcgtggcagatatgtgtcgtttaggtccttgttagattgttgataattcttcattcttggattttttagcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactgaaataaaaaaaaaaactctcccgcgct

SEQ ID NO: 91778 - DNA, 384 bp, Homo sapiens
tatgttcctttttttcatttcatgttctgagttacctatttttattgcattttacaaaagcatccttccatgaaggaccggaagttaaaaacaaagcaggtcctttatcacagcactgtcgtagaacacagttcagagttatccacccaaggagccagggagctgggctaaaccaaagaattttgcttttggttaatcatcaggacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactgaaataaaaaaaaaaactctcccgcgct

SEQ ID NO: 91779 - DNA, 323 bp, Homo sapiens
cctggaaagacaaccttcaggtccagccctggagctggaggagtggagccccactctgaagacgcagcctttctccaggttctgtctctcccattctgattcttgacaccagatgcaggtaagcagagatgaaagggtgaggtgacggccagggaacagcctagcctcacagatgagagtgcacgcttccactccagtgagcctggctctgcagcttggcgtctgtgtgactttgcgccattcacttaccttctcctgttgcctcagtctgtcaacttctggcctttgcacctagaatactcttcctgcctagtatctcatcg

SEQ ID NO: 91780 - DNA, 530 bp, Homo sapiens
gtatgttcctttttttcatttcatgttctgagttacctatttttattgcattttacaaaagcatccttccatgaaggaccggaagttaaaaacaaagcaggtcctttatcacagcactgtcgtagaacacagttcagagttatccacccaaggagccagggagctgggctaaaccaaagaattttgcttttggttaatcatcaggtacttgagttggaattgttttaatcccatcattaccaggctggaggtgaggttagtggtgcaggagttgctgaggcaggtggaaatcttgtaataaatgcctaaaaatgttttaagcaatttgactgggctctggaaagcattttgtgattctgaactaaaagatggacaagtaaattttatcaattaagaacaaacacccagagactatttctcttatccagaatttatgacaaggtcctgttgttcttattatcagtgatacttataatatggtttcttgggatgagtaatggagtttactccaagaaactcaaagcatttca

SEQ ID NO: 91781 - DNA, 329 bp, Homo sapiens
taacaagctgatcttgggtctgtagaagctctaagagacaggaagcctagcttgggaccaggcaggtcgggtgtgaaagttaacatccacagcgttagatcaggctcgtcatacaaatgtgggtccccagagtcagagtcaacaggactgcgttcatgtgagctgccagccactctaacagctgtgggcagcacctagaaacagccggcaaagtcgatttccccatctcaacattcttctctctcctgcaggtactcactgcagctatcctcatctccttgatgggctggagatacggctgcttcagtaagagtgggctctgtcgaagc

SEQ ID NO: 91782 - DNA, 689 bp, Homo sapiens
cgctcgcgggcttcagcgaggcgggagggcggccctgttgccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactgaaataaaaaaaaaaactctcccgcgct

SEQ ID NO: 91783 - DNA, 1110 bp, Homo sapiens
ggacgcgtgggtcgacccacgcgtcgcggacgcgtggctctccggggagcggaagcgccttcaatgcaggcctgtgggcaggggcgtgggggcgcgcacacacacacgcctgggtgacctctacgtatatacagagcctccctggccctcctggaaagagtcctggaaagacaaccttcaggtccagccctggagctggaggagtggagccccactctgaagacgcagcctttctccaggttctgtctctcccattctgattcttgacaccagatgcaggatggtgtcctctccctgcacgccggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtactcactgcagctatcctcatctccttgatgggctggagatacggctgcttcagtaagagtgggctctgtcgaagcgtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaagttcaggccctctgtggttaaagactgtatccatgctgtgctcaaggaggaactggcaaatgctgaatattctccagaagaaatgcctcagcttacaaaacatttatcagaaaacattaaagataaattaaaag

SEQ ID NO: 91784 - DNA, 1927 bp, Homo sapiens
ggacgcgtgggtcgacccacgcgtcgcggacgcgtggctctccggggagcggaagcgccttcaatgcaggcctgtgggcaggggcgtgggggcgcgcacacacacacgcctgggtgacctctacgtatatacagagcctccctggccctcctggaaagagtcctggaaagacaaccttcaggtccagccctggagctggaggagtggagccccactctgaagacgcagcctttctccaggttctgtctctcccattctgattcttgacaccagatgcaggatggtgtcctctccctgcacgccggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggtacgaattataaacaaacttcccctttaggtatccctggagtaataatgacaacaaaattcactgcaggtcggtggaatgatagaatgcattttaaatcacattgtaaacttccaggtgatccatggataggataaataactaagttattataattgtttaggaatttatagtccataaaatatcctccagccaggtctcatttcagcttcttgacaatcccataaagttggccatttgttacacatagagaagttgaggctcacagagggtaacaggcttgctgtaaaagcacacagtgaagttaaggtgaagtcagcacctgaccccctatctccctgttgttttgttgttgctgagacagggtcttgctctgttcccctgtctggagtacagtggcacaatcatagcttactgtaacctacaacccatgcactcaagcgatcctcctgccttagcctccgagtagctgggactacaggcacacaccactacacctggctaatttttaaattttctgtagagagggagtctcgctatattgcccagtctggtcttgaactcctgacctcaagtgatcctcccaccttggtctcccaaagcgctggattacaggcatgagtcactgtgcctggccccaacccccatcttctaaattcaacttctccagttattgtggactaaatagtgtttcctccaaatcttacagtaaagccctaacccccaatatgacagtctttggtggtggcactttttttttttttttttgagacagtctcgctctgtcacccaggctggagtgcagtggcgtgatctcggctcactgcaacctccacctcccaggttcaagtgattctcctgcctcagcctcctgagtagctgggatacagggcatgtgccaccacacccagctaatttttgtatttctagtagagacgggggtttcaccatgttggccaggctggtctcgaactcctggctgcaagtgatccgcccaccttggcctccaaaagtgctgggat

SEQ ID NO: 91785 - DNA, 495 bp, Homo sapiens
tggaaagagagagactggagtgagagagaaggagttaagaaggcttgagagacagctacaggaacagatgggtagaggcaaaagcttgggcagggtgtggcactggaatatgatatatgggggatgtctggaaggaagactttatcagaagtagtgactcatggactgtgtagatttactcattcaatcaccaaatgttcctacatgacctctcacagcacctctccaggcactgatagagataatgcagtggataagacaatgaacctgctgtcaaggcatttatagtctaccaggagagatagacgacacatttatttattttattttattttttacataactagacatctttatcttttgacaaatagcttttacaaacataattttcaagctctttccacaatataaatcattacttgggctccccttatttcattaaaaaaaaaaggattcattctgacttctctttccttttttttttttttttttttt

SEQ ID NO: 91786 - DNA, 459 bp, Homo sapiens
agtatacttgtatacgtataaacaattctaggacaagaaactggagaagtcaggatattagagacttttcactctatacccttttttattatgattgaattttttaattctacacagttttctcactttaaattacatatatacgaatattctacataagaccatttaaaataaacttttattcataggaaatgtaatggtttgtttgaaatttagtcataacatccctgtaagtttcatgcaattaaatgcttatcgtatgctaaacatttgatgagacgaccttaaatccaaggtagtcagagagcatatttgtagaccaagttttacatgggatacaatcaaaagaaggactacgtaatttgctgtattaggaacatttagcaaaaggctaacactcagctcagagtaattcaagcgaaagagtaaagttattatcatactgaggtccttcataga

SEQ ID NO: 91787 - DNA, 153 bp, Homo sapiens
aaaagatcgtagatcaacctaggaactgtggtagatgaaaggctcaagtcaatgagcgataggttggccagcagaatatacatgggggagtgtaagtgaggatcaaagatcactgtgaacacaatgaagaggtttcccaggataattcccaca

SEQ ID NO: 91788 - DNA, 420 bp, Homo sapiens
tggtctagcagtcaggcccacatgtgctggaggcagtggcctggggccgggtgtgggagtgagaggtgaccaggcaggctttcacagagaagacatctcaggaggggacccggaggaggtgtgggacttccccagtgccattactggcctgagcaaaggaggctgagggagggaactaatgttccctggacgtttgttatttgaacattttcagaggggaccacccaagggcacagttgtgagtcagagctaggatttgattgccttttcctctctggctgtgggcaggggacagtcagagggcagtgaagggttggaccaccccatcctcccccttcccctcccaccagatcccctacacttgctctaggagccaccgcaggaagtccagagtcaccaaatcatccctcgccatctcct

SEQ ID NO: 91789 - DNA, 282 bp, Homo sapiens
attatatagacaaaaacgcgtgcgtaactttgagacgccacggctgctgtttctaggtagctagcatccgccagggattgtggacgatggaggccgaggctctttgtcatagtattagctagctggtgtcgttttgacaacctgacttgacgggttttgagtgtatcttggcaagtgaggtgacatgaaagccattatctccggtttcacttgggtaatgaggatagcgatggaaatgaaattatctcctcatttagaaggcatttattccgtactccccaa

SEQ ID NO: 91790 - DNA, 726 bp, Homo sapiens
cttttttccccatcttttttcttttatttttgggacggagtctcgccctgtctcccaggctggagttgcagtgagctgagattgcaccactgcaccccagccttggtgacagagcaagactctgtctcaaaaacaaaaacaaaccataaactgggcgacttagaaacaacagaaatttctcacactcctggaggatgggaagtccaagatcaaggaaggcactggcagatttggcatctggtgagggagtctttctggttcgtggatgggcccagctctgtcctcacatggtggaaggagctagctctctgtggtctcttttatgtgggtgctaatttcaacctcccaaaggccccacctcttaatatcattacattaagactgaggatttcaacgtatgagttttgagggggaagacatcataaacatttagacatagtaataacataaaagactttggcctaatcttggagaggggagaatctttagaaccatgacaaaaaaatcagcgccataaaggaaatattaagtaaatttgacaatccaaaactgaaattttctatagccaaaaaaaaaaaaactataaaccaagccaaaagaaaaattacacactgatgaaaaatatttgtcataaaaatgataatccaatataacaacccaatataaaaatggtcaaaagacataagcaggcattttccagaaaaaaggataagcaggcaatgtacc

SEQ ID NO: 91791 - DNA, 407 bp, Homo sapiens
agctttggtcagtgggagctctcttagttagctcctatatccttttgacatatcctcatcaatagacgtttttgtttttcttgtttgttttgaatacttctttattactggcattaagagatggtccaggtccatcttgtgtatttcttgccccagtcctagaatcaaccatttctccaaggagccctggtaccttttattggagaatgatattagaaaccaagatatgggtactaggtgagctcattgctactgggatgtcattgcttatagaccctttcagctgagaaagccaagaaatacacacactaacccatgtatatacacttatctataaatatttctatatgtaactaaccatctatattgtattaaggtacacgagttcatgctgtttccagcccttt

SEQ ID NO: 91792 - DNA, 374 bp, Homo sapiens
atctagtttcagagataacaaaaatcgccttgtttcatgccttttatttaataacactcctttctttacctggcatgcccttgtctcatgagtaaatacattgcaagattcattaggtatccctaggggtagaaagaagtacaatctgattttaagcaaaaataaggttggttcataggtggtttgggacctgtctcaagtgtcaatttgtcattaagagtaaaggctcgataattgactggaaagagctttttaaagtttcaggatcaacttaaaatttactttgctcagaatatctatttaatgtttagttctcactcctgcaaaaatatactaaatcaggatctagttgtttgacaaaactgaagcaaagg

SEQ ID NO: 91793 - DNA, 346 bp, Homo sapiens
taccacccacgctggagtgcagcggcatgactatgcctcactgcagctttgaactcccaggctcaagccatccttccacctcagcctccggagtagctgggactacaggcacgtgccaccatgcctggctaatttttttattttttgtagagacggggtgttgctatgttgtcagggctggtctcaaactcaagggctcaagctatcctcccacttcagctttccaaagttttgggattacaggcatgagccactgcacctaactgctttcttctttcaatagatatttttcacttttaagaaaaaaacccctgcagcacatgctaaaataacactaaggaagggt

SEQ ID NO: 91794 - DNA, 458 bp, Homo sapiens
tgttgcattactgtatgctgggtttttggtactctttctcaaggctctgttattagttggtaggctccagtaatgaatatagaggactgacagagtgggattaacttatttgcaattgtttcctactgaaatcaaatgcacggttttcccaatttaagacttggtcccttgtaccttgatttgattcagaaagccatctgtgatgtttttgtttcctggcgcctgcaggaaaactcatttgtcatgagttacaattaccttgcagtcattgctatgtggttgtagcacactcattgctaagaatggtttatgagtgtcaccttaatccatgagctcaactgggtgtcagacgtctaggaagggagggacttggtaggtacttaaatggtaaactcagggtgctgcatggaggtgattaaggaggtggcatttggtttgagtcagggcttttagtgcta

SEQ ID NO: 91795 - DNA, 450 bp, Homo sapiens
ccccactgcataatgggaataacgaaagtatctactgccttggggtgctgtgggaattccataaccttcttgcgtgatgtctggtgtgcagggctgacagtggcttgaaccatggagggaccagatgtgatcagctgccctcatgtcagtaacacaccccacagccgccacatcaccaagccctgccacagactgtttcctcctcactcaaggatgcctcacgttttctttctccatctgaaatcactaacccatctgctcttaaaagctgagctcagcctgggcgcggtggctcacacctgtaatcccagcactttgggaggccaaggcgggtggatcacttgaggtcaggagttcaagaccagcctgaccaacatggtgaaaccccatctctactaaaaatacaaaaactagccaggtgtgatggcgggtgcctgtaatcccaactac

SEQ ID NO: 91796 - DNA, 500 bp, Homo sapiens
ggaagaaagtgttctagctggaatgatgacagtcacacggcttcccaaaagttctgaggagaagcacaacatggagaagtacaggtcaattttgccaatttgaaacgctctgcagccctttgcctgccatgggcctggtcagagctctcaaatggccccatctctcttatctcagacaacaaatgctctgtgctgctttcctgagtctccatttttctacctgggattaaagagttccaagggccccttcagctccaaaaaactgggttgcaaatagaacccgagctctagttcatttactaaactgcactgcacatccagaccacttatcctgagcttaaagtttcaacagtccgcgtaggaatccattgactagaaatacttaacagaatgtcagttgaatagagaccttataaagcacttctgttcaatataagtagtctctgatctgcacttttatcattgctactaaatgctcctgaccctagtaaataataaat

SEQ ID NO: 91797 - DNA, 1913 bp, Homo sapiens
gccaagctgaaagttctactctttctagtggaatatcaataggtagcagcgatggttctgaactaagtgaagagacctcatggcctgcttttgaaagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgcctta

SEQ ID NO: 91798 - DNA, 1897 bp, Homo sapiens
ataattacattttatttaagtacctacttgatgactattgtagacaaaagctcttatgtgttcttttcttcgttattatagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgcctta

SEQ ID NO: 91799 - DNA, 709 bp, Homo sapiens
actctgtcactcaccgggcgggccaggccgggcagccatggctgagacactcttctggactcctctcctcgtgggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 91800 - DNA, 1430 bp, Homo sapiens
actctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcccagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 91801 - DNA, 1058 bp, Homo sapiens
actctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcccagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 91802 - DNA, 654 bp, Homo sapiens
gcaacttgcccaagacacacagccttgaacccaggctgtctacacccacagcccatgtcttgaccactgggcactgagcaggcaccatagagctttctgtttgttttctgcccctgcatcatgtgtctgagtctctccccacataagtggtggggaggaccgcagggtggctcagaggcagttccaggctgtactccagggcagctgactcccagagctgatgactccccacctgtgcctccagcatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcccagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 91803 - DNA, 903 bp, Homo sapiens
actctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcccagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 91804 - DNA, 2810 bp, Homo sapiens
agattcgcggccgcgtcgacggtgcgcccaccggtcccgccgggcgcccgcgggacgcgccgccagggccctctccgccgggggctcggcgctcgcccacctcttccaaatttaaccattacctaaatccgaagggaaatgagcaaacctctcggattgggtgtcaaggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcagacagcacttcaaatgcaggcggggcgaaagcggagccccgggaccgtttgtcccccgaatcgcagctgaccgaagccccagacagagcctccgcatcccccagacagctgcgaagcagcgtctgcgaacggagctcggagtttgaggacttctggaggcccccgtcaccctccgcgtctccagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgtgaacccgccccggagcctggccacccggccgcgctgtacggcccgaagcgggctgccggcggcgcgggggccggggcgccagggaactgcatcgcaggggccggtgccaccgctggccctggcctagggctctacggcgacttcgggtctgcggcagccgggctgtatgaaaagcccacggcagcggcgggcttgctgtaccccgagcgtggccaccggctgcacgcaaacaaaggcgctggcgtcaaggtggagtcggagctgctgtgcacccgcctgctgctgggcggcggctcctacaagtgcatcaagtgcagcaaggtgttttccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagaagcttcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactccctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagtaaaaaaaaaa

SEQ ID NO: 91805 - DNA, 495 bp, Homo sapiens
ggggcagaacctggagcacacacaaggatagcagatgaagagtcttcacattagctcgatgaaggttgtgggaaactggggacagagctcgacaaagcacacgtaacaacaagtgcatagggagacctggtctttgtagagtgactatgagggtgggctggtgcattcccatctaggtgcctgtgcagttgcctgcttctatcaggcctggtatagaaagcagagtgctccagcctagggctgacaagcaccagctccagttaagctgaggaaaatgtcctgtttcaatcaattacatgaatcccatatattacttgggtacatctttatggttgcttttccctgctgggaaaatggtttccaatgagtaaaatttcataaattatattatagttatacttccaacaagctaattaattgtgttttattactattacttctgccttgatgatagtccattaaaggtcattaataaatgcagctgtgttgagattt

SEQ ID NO: 91806 - DNA, 6010 bp, Homo sapiens
aaaaataatgccattttttgaatgatgaactatggtataatgcatttagtgttcattccaaccgtcaatcaataaataacatgggcctctagctataagggcaattctataggtaaaagaactgattgacccccacccccataggtgctgtcctgctatggaatccctttgctcagttttctcctgtccaatcaggtggaatgtttcacaggcacatggtttatacagctcaaaataacttgggacctgtgagctgacaaatgctctggctccggtggtgacaggttgtccagcttcttacagccatcttcactgaaactaaggttaactcctcactctctatggacggctactctctatttccaagggcgtgaagaatttccctcttctcctgtgctttcatctaaaagttctccctggataattatcattgcagtggagtgcctggattggacatcctcatctgggtcaactaaaaaaagaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaaggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcaacatgactgttttgaactccaatgctcccccagcggtgacaacatccaataagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccaggggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttgggaaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagtcacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttactctaatcaccaattcaaaccctgcctcttaaggaatttttagacttaagttcactgtgatatccctagtacctagaagagtacctagcacaaagtagacattcaataaatatttgctggttgaatgaatcttctgttattatgtctattataagataacctaatcttatattctgcaggaatatgccacccacacaccagtccaaacactgccctgggaatgctcatcacagcatagtttgctctaggctgtgcagggaaatgaattgcaggtgtctgttttcaattccctgtgctggaatccctggtgctgtctgtgcgaagcacactcagctggcattgtatttgtgtgaacagacagtaactgcttagaaaggcttgaaactgtcttcacttcaaggcaaggatttccagcataaaaataaattcattcactggaga

SEQ ID NO: 91807 - DNA, 2384 bp, Homo sapiens
  misc_feature (1975)..(1975): n is a, c, g, or t
  misc_feature (2194)..(2194): n is a, c, g, or t
  misc_feature (2364)..(2364): n is a, c, g, or t
  misc_feature (2368)..(2368): n is a, c, g, or t
aaaaataatgccattttttgaatgatgaactatggtataatgcatttagtgttcattccaaccgtcaatcaataaataacatgggcctctagctataagggcaattctataggtaaaagaactgattgacccccacccccataggtgctgtcctgctatggaatccctttgctcagttttctcctgtccaatcaggtggaatgtttcacaggcacatggtttatacagctcaaaataacttgggacctgtgagctgacaaatgctctggctccggtggtgacaggttgtccagcttcttacagccatcttcactgaaactaaggttaactcctcactctctatggacggctactctctatttccaagggcgtgaagaatttccctcttctcctgtgctttcatctaaaagttctccctggataattatcattgcagtggagtgcctggattggacatcctcatctgggtcaactaaaaaaagaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaaggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccaggtaangatgatttcaactttaatttattagtatatgagtgattttatatatacaagaatacataatgaagttacactgagatgaataaaaagtgaaaaataaagttttaggaaaaaaagatccaaatgggccgggtgcagtggctcatgtctgtaattccagcactttgcgaggccgaggcgggcggattacttgagatcagaagttcaagaccagcctggccnacatgacaaaatgaaaccccatctctactaaaaatataaaaattagccaggcatagtggcgcacgtctgtaatcccagctacctgggaggctgaggcaggagaatcacttgagcctgggaggtggaggttgcagtgagccgagatcgtgacactacagtccagctgcgcnacanaacaagaatctgtctc

SEQ ID NO: 91808 - DNA, 415 bp, Homo sapiens
ctcacctagtctcatggcttgaagtattgtttgtttgctgatgcctccactggaatgaaagctccatttaaaccccgtgggtgcagcatgtttttgtctgttttgcacactgctatatccatagaatctagaacagtgcctggcacacctagtaagcactcagtaaatatttgttgagtgaaatgattctattattgttatttttattcccattttacagatgaggaaacaggtttagagacaataaataaattaccagagttttgtagctaggaaattgaactgggattcaaaaccatattcttaacctctacatgtactgccttccttaaatttgatgtaattgttagtgtttttctgtatgtttagttgaaacctgcctctcagtaacttccaccacaatatatatgtatga

SEQ ID NO: 91809 - DNA, 372 bp, Homo sapiens
aaacatctgtcatggaggcaggtcattatgaggaatcttttcctgcctaaaggtgccttagaaaggagcatgtttgggaaaacaggaagtaggtaagttcagagtaactgccagtgccacagatgtgcagatcaaatatcatgattagttcagccaacttctctcctctgtcctagaccagcccaagcctgggacacggggaaggcaccaaaaaactccggtgttgtgaggtattttattcacctcgtaggggagtgttttagttagaccttatttattttatctattttgaggttaaaactgatgtcggtattatgatccctccaaaacagagcttccaaaaaattctgttgtttcataacattagtactt

SEQ ID NO: 91810 - DNA, 542 bp, Homo sapiens
aactggggaaatcaaaatttggcagatcgtatcaaaatctgggttgcgacattgtactatagttctgcaagaagttaccattgttggaatggcatacagaatctctctgccttgcttctggcatgtgaacctacaattatctcaaaaatttcaattaaaaaaagagagcttcaaacattgactcatcttttggtctcctgtttgaaattttgtcaaggactcctactttaaatcattttctttatgaaagtcacgttaagagtcaaaaggaatttgagaaatcatttagtccccacattacagaaatagatttccaaaaatactctagaatctacacttcatcttaacatgctcaaattgttagtttaatcgatcaagtattccttaagtatagcaggaatagacagatagccacaagggtatttaaaatgctcctctgacacataattcacaatacaattcttttcccaggaattttagtggtgtactagtcactgagctattatctcacttcgtggtagtatcttcatcagctcagtcaa

SEQ ID NO: 91811 - DNA, 663 bp, Homo sapiens
ttattcctctgtatatgtttcctccacacatacagagctacttttaccattttttctttatcactggtttgcagtaatttgattaaaatattccttggtgtggttccctccccctccacttttcttctgtttcttggatctgacaatgtaaagttttcctcaaatttggaaaaaaaaattgtttaagagatggggtcttgctgtgttgcctaggctggactcgaactcctgggttcaagtgatccctccacctcctgagtagctgggattacaggcacacaccactgtgcacagctcaaatctgggaaatttttggccattatttcttcaaacatttatctgtctccccttctttctcctttgcttgagactccagttacatctgtgtgagacttctagatgttgtcccctaattcactgttctgttttttttgtttgtttgtttttctttgtctttttctctctgcgattcattttggttagtttctattgctgttttcaaatttagtaatcttcttcagtgtctaatctgctattaattccaatcagaatatttgtgtttcatatattgtatttttaatcaattaaagttcagttcaatttgtgtcttttgaaaaaaaatagtatcttccatttctctcctcctcatgatcattctttcct

SEQ ID NO: 91812 - DNA, 628 bp, Homo sapiens
gcggccgcggcgcggagccgagcgggcgtccgtcgccggagctgcaatgagcggcgcccggaggctgtgacctgcgcgcggcggcccgaccggggcccctgaatggcggctcgctgaggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggtaagatctattttggagaaatctattatttggacctaaatcgtaagtcatgaaatagccatcctgtaaatatgacagtttaaggggtctttctgagttatagatatggtttaatttactcaggagtatgcccatctgatgtgttcactttagcagcacatatactaaaaaaaaggaaaaaaaaactggaacgatacagagaagattagtgtggcccctgtgcaagggtgacacaccaattcatgaagt

SEQ ID NO: 91813 - DNA, 561 bp, Homo sapiens
gcggccgcggcgcggagccgagcgggcgtccgtcgccggagctgcaatgagcggcgcccggaggctgtgacctgcgcgcggcggcccgaccggggcccctgaatggcggctcgctgaggcggcggcggcggcggcggctcaggctcctcggggcgtggcgtggcggtgaaggggtgatgctgttcaagctcctgcagagacagacctatacctgcctgtcccacaggtggttctggaatggagccgagatcaataccatgttttgtttgattcctatagagacaatattgctggaaagtcctttcagaatcggtaagatctattttggagaaatctattatttggacctaaatcgtaagtcatgaaatagccatcctgtaaatatgacagtttaaggggtctttctgagttatagatatggtttaatttactcaggagtatgcccatctgatgtgttcactttagcagcacatatactaaaaaaaaggaaaaaaaaactggaacgatacagagaagattagtgtggcccctgtgcaagggtgacacaccaattcatgaagt

SEQ ID NO: 91814 - DNA, 347 bp, Homo sapiens
atttctctagcaattctaatgaaattaaaatgaaatgaaagttatatactcttagtctttgatgcgaagaaaacgtttctttttctttgttctaggtggttctggaatggagccgagatcaataccatgttttgtttgattcctatagagacaatattgctggaaagtcctttcagaatcggtaagatctattttggagaaatctattatttggacctaaatcgtaagtcatgaaatagccatcctgtaaatatgacagtttaaggggtctttctgagttatagatatggtttaatttactcaggagtatgcccatctgatgtgttcactttagcagcacatatact

SEQ ID NO: 91815 - DNA, 812 bp, Homo sapiens
gcggccgcggcgcggagccgagcgggcgtccgtcgccggagctgcaatgagcggcgcccggaggctgtgacctgcgcgcggcggcccgaccggggcccctgaatggcggctcgctgaggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggctttgtctgcccatgccgattgacgttgtttacacctgggtgaatggcacagatcttgaactactgaaggaactacagcaggtcagagaacagatggaggaggagcagaaagcaatgagagaaatccttgggaaaaacacaacggaacctactaagaagagtgagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatgttgaagatgcccactctggactgcttaaaggaaatagcagacagacagtatggaggggctacttg

SEQ ID NO: 91816 - DNA, 777 bp, Homo sapiens
gcggccgcggcgcggagccgagcgggcgtccgtcgccggagctgcaatgagcggcgcccggaggctgtgacctgcgcgcggcggcccgaccggggcccctgaatggcggctcgctgaggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggtctgtgaggtaaagggaatttcatccccctgtaggatgaggaaaccaggtggctactacacagcggtttctgagccctggccggaattctgttgacagcgtcctgtgaaatgggaccactccccagtaaaccactggggctgaaccccactccattggtcactcttgctgcttacctatgagggaggagcaaacagcctcatacctcattagtgtgggtctttcccttggaaggccaagcttcttagtgccgccattctggaacgcagtcttcaccatttcttgtctttggggattttttttttcctcttcacaagacagacctcagaatggaaacaatttttttcaacaccctccttccctttttgcagataaaatgaatcacacaagtcctttct

SEQ ID NO: 91817 - DNA, 511 bp, Homo sapiens
ttttttttttacaaagaaccatgtggtatctacattttgggttttgcaggtcacataggtctctgtggcatattcctctttgttttgtaacaatcctgtaaaaatgtgaaaaccattcttagtcctggggttgtacaaaaacaggccagggcaggctttgaaccatgggctgtagttggtgatttctgacccattgaaaacaagttgctattcattttattttggaaagcaattttttcctaggtggtagaagacacaactgtcaattcagcaacgtgacataagaggtacactcagataaaacaaaaacaaaacaaaacaaaaagggtatcatgatcaggttggaaaatcagagcccaggagagtatctgtgggactgagaggtctggggtctaacaggagagcagagggcaccactgtcaccgcagcctccacctcccacaggaagcaactcagatccggccaactggacacttgaggatgactgtgtgtggggccaggcgcaggggct

SEQ ID NO: 91818 - DNA, 451 bp, Homo sapiens
ccctggtctccacgctcttgcccatggccccctccaggctattcccgggtttctcagccttggcactattgactttttgggccaggtaattttttgttgtgggcagccatcctgtgcattggaggatgtgtgtgtctagcatttctggctttaacctgctagatgccataatcgtcaaccccctccccagctgacataaccaaaaatgtctccagacgttaccaaatgtcccctggggaaacatcaccctggcttgagaaccagtggtctagtctcaacacagtcaccagagaaatcttattaacattgaagtctgcctgtgtcccttacagccctcccatcctacgccagtaaacaccaaagctctccaatgggccgcaggccctcgtgagctccctaactcatctcacgccatccctgctgtagccagtgactgtgccatcctatctca

SEQ ID NO: 91819 - DNA, 138 bp, Homo sapiens
accacaagctaaaatttattaacctttgttcacaatcctgaattaatccctatttactgtgatgacagtctgaaattaaaacttttgaaaagaagaatacctaggccgggtgtggtggctcaagctgtaatcccagca

SEQ ID NO: 91820 - DNA, 181 bp, Homo sapiens
atttttgtatttttagtagagatggggtttcaccatgttggccaggctagtctcgaactcctgtcctcaagtgatccacacgcctcagcctcccaaagtgcttagattacaggcgtgagccaccgtacccagccaaaatgcttatgttatacgttatttaaaaagaataccagtagtccac

SEQ ID NO: 91821 - DNA, 399 bp, Homo sapiens
acctattatgtgccatgcatgatgccagggacaaagtaggaacctgatctactcctggggaccaaggaggcttcctttcgagaagtgatctggagctgaggtgtgggggctgagtaagagtaacctaggtggagggtgctcctaactttaagaacagtctctgtgctgggcctgtggagggagtgtgctgcgtacccaaaagacttgaggaaagaccagactggagaccagaataccagcaggaaatggctgccatagtcacacaagcaagatgatggtcacttggactagggtgggtgccagaggagacagaaacatgaaattatgagatgatttgtagctagaatcaacagtacttgctgactaactgaatgtgggaagtggagtaagaaagaaaga

SEQ ID NO: 91822 - DNA, 227 bp, Homo sapiens
  misc_feature (36)..(37): n is a, c, g, or t
tgtcaccagtcactgctgggatgggagaggggtccnnatggggccgggaagccatgaccatgggagaacatgggatgaactcagcacacacactttactcaggttggaagcagaacgaaaacccaacaccactggcgggcgatgtggaggggcagggaaggaggaaggtgctggggccaggcctgcggggacaaggtgatcagcaaaaaacagcagggagggcagga

SEQ ID NO: 91823 - DNA, 771 bp, Homo sapiens
  misc_feature (771)..(771): n is a, c, g, or t
cagctgggaaagcaaagagataataaaaaacagaggtaatggcatggcacaatggctcaatgcctgcaatcccagcactaatgggaggccgaggcgggcagatcacctgaggtcaagagttcaagaccggccgggtgcggtggctcacgcctgtaatcccagcactttgggaggccaaggtggaaggtttgtttgagctcaagagtttgagaccagcctgggcaacatggtgaaaccccgtgtctactaaagacacagaaaaatagccaggtgtcgtggtgtgtccttgtaattccagttactcaggaggctgaggtgggagaatcgcttgagcctggggaggttgaggctgcagtgagctgtgatcacgctgttgcattccagtctgggtgacagaaggaaaccctgtttccataaaaaaaagaaaaagattgctgaccctggattgagagatttttattagatttttttttttggcaagtaaacttattaggtgttggtgtatatttgcatatgtggcgtagaatatttggtgtagaacattcatctttttgttatattaacagccattgaagaccatttcttatacgtactactttttcattgatcagctacatttttgatggttacttttcctacatttttgatggatgtttttgctatatcattttaggttactatttttcttttactatcttctggcttccattctttatcacttattgttagctataagccttatcatcatccttttaaaggtaatctgtcccn

SEQ ID NO: 91824 - DNA, 707 bp, Homo sapiens
  misc_feature (692)..(692): n is a, c, g, or t
cagctgggaaagcaaagagataataaaaaacagaggtaatggcatggcacaatggctcaatgcctgcaatcccagcactaatgggaggccgaggcgggcagatcacctgaggtcaagagttcaagaccggccgggtgcggtggctcacgcctgtaatcccagcactttgggaggccaaggtggaaggtttgtttgagctcaagagtttgagaccagcctgggcaacatggtgaaaccccgtgtctactaaagacacagaaaaatagccaggtgtcgtggtgtgtccttgtaattccagttactcaggaggctgaggtgggagaatcgcttgagcctggggaggttgaggctgcagtgagctgtgatcacgctgttgcattccagtctgggtgacagaaggaaaccctgtttccataaaaaaaagaaaaagattgctgaccctggattgagagatttttattagatttttttttttggcaagtaaacttattaggtgttggtgtatatttgcatatgtggcgtagaatatttggtgtagaacattcatctttttgttatattaacagccattgaagaccatttcttatacgtactactttttcattgatcagctacatttttgatggttacttttcctacatttttgatggatgttggctgaccagatgcgtggactgaccccggatgttggntgggggtcctctaga

SEQ ID NO: 91825 - DNA, 184 bp, Homo sapiens
cactcttaccttttcttccttttaattctagtgaggatgctgacacaacctgtgaccttaggcaaattacttaaaactaagtctacatttcttggttgtttttttttgtgtgtgtttgagtctccattttcttaactataaaatgggatattagtatctgccttgcaactttattgtaatgtat

SEQ ID NO: 91826 - DNA, 332 bp, Homo sapiens
tgctctacagtaaatatccctgggatgagtatcttgttcatagctgaaaatgcagaagttctggctcattccataaaatgtctttgaagattatattatatccctgtctgcctccaagtgccacccctaaacactacttcagtttgttagttaggtaacttgtgttttggatgctatttatgtcatatttgtaaatgacaagaattgatcattggtaaaatgttacataagttagtacagaattgtattcttacagtgaaggacatacaaaaattgtgtctgagttatgacacactttcatttcggtaaatcgtgattttgtcaccttatga

SEQ ID NO: 91827 - DNA, 492 bp, Homo sapiens
aggaatctctgatcccagaaagcagcacagtttgcagttgtaagagcaattctgtctacactgacccagacatccctttccccaatctgggaccttctgagaccagcaggatgagaagcagtgttggcccagatgctaggggtgggtcaggtgtgacagtgaatggctggcaagcatcccaacagctggaaacagctgcaacttctgaatggcagggaaacttaatttggtgatgtcagtttctctgggcagttggatgaagacttgaacccgtattgtcaggagtttcaaaggtgaccaagcaaaatgaacacgtattccttactctctcttctacactcaccatgtactatatgtgaggcccgtctaaactctagggatcagctgggagccagacagaaagagtattccccttttaaaggatgccacattccagtgctggagctggacaggacacctggacagggtaattgcatgtcctggtcagtgctg

SEQ ID NO: 91828 - DNA, 1722 bp, Homo sapiens
atttaaaaaaaaaaaaacaacaaaagagtttgtgtgtggccaggactaaacagctgcttcttaatttttgaattttaaaactaatctattttatttaaaaaaaatcaagtactttggaagtgaataaagtaagagatagcctgtctcactttccagaggtagcagtcactaatactgtggtgagtgattttactcaaaggaaatcacactattaagcagcttggttttgacatgttatgttgtggtcatcttttcatgtcaatacatagattaatcttttatttcaaatgtctacataaaatatcactacccacataacctataatttgtgtggccagcaatttattgaacactaaaatgttttaagttttcttattgctaacaatgtcacagtgaacatttatatattcattaaatccttttcctcatgtatctttgcactcttgtgctagtatgtctatagtgtgaatacattcataaatttcttgatcaaagctaggtcaaagttacattcattttaattttggtacatatccataaattctccataaaagtaggaccaacttacattaccaccaatagtgtatgtgagccttatttttatgtatgataggactttttttagtccaaatgttcctatagattttctgggttttttttttttttttgtccttggaagaataaccttccttccaccaagtccaagaacctgagaattttaatcatataggttttagatttcctttagcagcagagactgacttgctgtatagagggaagtcaagtagtgactaactcactatatgtcaaacacatcattactcttctcttttcctactttacatgtaatggttgcgaggaccaactttcaaatgagctaacttgggtgagacgttcactaaagtaccaagcacaatacaaatgcatcttcgagttctttgggcctcactttccctatctgaataataaggatagtaatcccttgccttttctcaaaccagttcaactcagcaaacacttcctgagcacctgctacatgccaggcaaaatgtgaaatttgcatgctatgaggctaaatggtactgattctcaaaacaaggagctcatagtctaaaaccatttttctttcttttttttccccctaaacaacctcttaaaggggtaagaagttagggggttgtttattaagaacccctgaagagcaaccctttaccactctcttaaatttgaaaaattccaaaataatattaacacctcttgactagaaaaggaaaaaaaaaggaacatgccgtatgaagagcctctccaataataaatgcaaagcagctgtcaaaatatagagtcaagtgatactttcataaagtgtttgcacaattagaaaatgttatcctttttctcgggagaaatgggacatttttattttctctgctaagtgaaatgcaactttttgaagaatcaacatgcttgacatttttacaatgtacataaagaactgaactattattaaaacaacttacacactccattgcttataacttttgagagaatgaaaagaaccttaaacagaatgtgcctgtggagcttcgctttagaaatgaaatacccaaggtgttttaactacaactgtctacatgtaatagtgtgtctgcataatgactttgtaaatattaactgcaattctgtatttgctttcttgatatgacttttaacatttaaactata

SEQ ID NO: 91829 - DNA, 356 bp, Homo sapiens
gaacataccagtaagcctagtagataataaaaagggtaaaaactgaaggaagaaagaaaatggtcattatttatagctcaaattactgtctatgtagaaaatccaacaaaatctatagaaaatgttttggaaataacaggagagttcagcaaaattgtgggtaaaagatataaaaattaacagcattcccatatgccagcaacaaacaattagaaattgtatttttaaagagatactatttataaaaaggaaaaggaaagtttcaaaagtattgacccacagataatttattcattataaaatgaaggaaaaaaaaaaacactgtgcaatctgccttttaccaagccaaccgaatg

SEQ ID NO: 91830 - DNA, 106 bp, Homo sapiens
ctctgaaagggagacaaactgcccatcctctgaggacttggggtggattatctccacaccctcccaagcagcgtggtgaaggcagagggtggcctgcggcggcgcg

SEQ ID NO: 91831 - DNA, 179 bp, Homo sapiens
agagggaaattctgtctcaaaaaaaaaagtgttgactagacagaaggtgatattgctgttggggaggatggggctgaaccctggagggcaggggtgctaggtactttttcctacattgacttgatagaaattaggaggccacaggccaggtgtggtggctcacgcctgtaatcccagca

SEQ ID NO: 91832 - DNA, 210 bp, Homo sapiens
gtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaat

SEQ ID NO: 91833 - DNA, 226 bp, Homo sapiens
ggctaattttttgcattttttagtagagatggaagattttgttttaaaagagatgggttgtgtgtgtgtgtgtgtgtgtgtgtgtgtgcgtatgtgtgtgtactggtcaccgtgtctgtggtgtattttatgtgtcaacttgacaggccaagggttacccagattatttatttttgagacagggtcttgctctgtcacccaggctggagtgcagtgacaccatctc

SEQ ID NO: 91834 - DNA, 428 bp, Homo sapiens
ctaccttaagagcaacaggttaccttagctttatggaggcaaccgtatgtggttgtgtgtcggcgaggaggtggaaacagcactggcatttgttttctagcaacgtgctcaaacagccattgtcttgaacttggtgcagacttccgccaagctacatcacctcttaattgatacagcttgagactatctcccatcacaaagaatgcttctagatctgcctggggacctgggacattccatttctcgtgccagagaaccacaatatagctatccttctagttaaactatccttctagggtcctgttaaacctagtaacagaaacttggtatcaccacagcaaatattaatcaatataatagttagtctctgcattctttgttattccatcccttactgcctagagaatttgcatgtcacattaagcagt

SEQ ID NO: 91835 - DNA, 639 bp, Homo sapiens
ataattacaggccactcttgctctcaagtcccattgtaaaggaaaaatacctattaccctgtcttcattccaggtattgaaatgcttcttacaaagggatctaacagatttcttagcaggggcccagggaaacacatttatttaatttttttattttttcaaaagcaatattactgctttgaaatctttcaaagtgaaggctgttatagagcttaataatggatctccttttacttgcctgaaattattctgaagcctgttaagagcatgccccgtattatccaaatagccatacagttaaatcaattttaaaacattgtaaaaggctgttttaacatcaatttttattttaattgaagcaacatacacatgtggtttagaaaaccaaattgtaaaaagacagcagctttgaatccctcctccccaccctgccccttccacacagtctgttactggagactgttgttcggtggaggattttgtgactatacctctgtcttagtcagggttctctagagggacagaactaataggatagatgtacatatataggggagtttattaaggaatattaactcacgcaatcacaggtttccacaacaggccgtctgcaggctgaggagcaaggaagccagtcca

SEQ ID NO: 91836 - DNA, 527 bp, Homo sapiens
caagaatctggagttctgaggtacaagggcaagagaagaagggtgtcttagtgagagagagagagggagtgcactccagttcacctttcctttgcttttttgttctatacaagcccctcaacactggatagtgcccacccacattggatgaaagtggttcttatttattcagtccactgatttaaatgccagtctcttctggaaacaccgtcacagacatggcctaaaataatgctttatcagctatcagggtattccctaacccatcaagttgacacctgaaattaaccatcagagtgtagaagtgatacagagttccccacctctgcccaccctcctaagctttcacctagttcgagtacaattgtgagaactaggcatatagctttgcaggaaaaagtacagcagagttaaattgatgaagaagttctaatccctggctgcttttcatgctacaagtagatgcagcaaactgaaaacttgccaattatctgaaggtctattgagatgttgcagctgcatgtgtt

SEQ ID NO: 91837 - DNA, 398 bp, Homo sapiens
caccctaaggggcagatatattattctcctgtatactggatcgaatagtgtctctgaaaatgaatgtccatctggagcctgtgaatgtgaccttatttggaaatacggtatttgcagatgtaatcaagttaaaattagatcatactggattagtgtgggccctaatccagtgacagacatggcaaagtctaggagtccccacagttactctcttgcaggtgctatcagtgctactcaactttttatgtttctctcttcacgatccccatcactactgcctttgttccaggtctccttggcttgtgcctggaccatcgcctaacttctaacggcctctgtgtttcctctggcctctcctcactcaaacccattgtaatcagatcacagtcccagaacca

SEQ ID NO: 91838 - DNA, 328 bp, Homo sapiens
acgcccatctctgggggtcctgccatctctttacaccttccgctccgtgggcaccttcaatatcatcgtcacagctgagaacgaggtgggctccgcccaggacagcatcttcgtctatgtcctgcagctcatagaggggctgcaggtggtgggcggtggccgctacttccccaccaaccacacggtacagctgcaggccgtggtcagggatggcaccaacatctacagctggactgcctggagggacaggggcccggccctggccggcagcggcaaaggcttctcgctcactgcgctcgaggccggcacctaccatgtgcagctgcgg

SEQ ID NO: 91839 - DNA, 376 bp, Homo sapiens
aacacagatgcaaatggtatctattttttatggagaagaaaggacttctcagaggacaaaaagcccacagttcagagtcaagagatgtggagaagaatggactagagaaacattcagaggaagtggtaagaggcaatgtactgaggagccactcagtaggaaccaagtgactcctagtcaaagaatatttccaggcctgcgtgtagggcaacctgtcaacttatgctctacaagacttcagaatgataatgaagcagtaatactatgtgcctcccactggaataggaatactgatttccattttctaccattgtaacttaggtttgtgcggatcagacaaattgtaatttttagttcatatacatcaagaggatcc

SEQ ID NO: 91840 - DNA, 226 bp, Homo sapiens
cacccaaacctgggcaagctgtgttagtcaggaagaggctgcagcatacggagaagcctcacttgtgggtcctgagtccctctctcccacactaagcatgctttggtttgcaggaaggtcatgcattcagattacaccctgataggggcacccggccatggagttgtgtgggactgaagcctgacccactgtttgcatatccagccatgcttcctggtacagaaac

SEQ ID NO: 91841 - DNA, 574 bp, Homo sapiens
  misc_feature (282)..(282): n is a, c, g, or t
tatttagctgaatcaaaactccttcaatgtcccataccaacttgttggtgggaaattttcctaactccactgacttggaaaaattcttctattacacgcacaaaaaatacagcagtaatattaaaagaagccaaaataggaaaacaaattcaagctagcttctcacccataacttgattaatgcctttagtttttctacatttcagtttcagtctcgaactcctgacctcatgatctgcccacctcagcctcctaaagtgctaggattacaggcgtgacacncgcgcccggctggaccccgacttcttgtgtggctttgggcgaggcttgccctcctctgggccccacttgctcctctgtaggacaatccgatggttttccaggtcttatccaatggctctaagcggaaggagggacaacattttctgaggcctccagcatgtccagcctgtgtcaaatgcgtgactcgaattgtctcatttatatcccccataacccctgagaggcagctgctatcactcccagctcacgcaggtccacagagtttaagctccatggctcccaaatacatatt

SEQ ID NO: 91842 - DNA, 514 bp, Homo sapiens
ctttcccgttgtagcaccgtctgctctttctgtgaacaatctccaggtctctcctaggatcatctttatttgttctctttattttaagctttcacaataaatactttagttaggctcactatctctttttattcaccccactccgactcttggaattcctgtaatctggcttcctacgtctagctctctagtgattgatttctcaaagttatcagcattccttgtattcttgatcttcattttggtaattatgggtttctccagtgggaattatttctatgtatttgcagtgggaggataaggatggcagaccttgctttgtgttgtttctctttgtgtacttgcctgagtacatcaattagactgtgagcctccagagggtaaggatcaaccattagacattttaaagcataatctccccctaatagatcttccataattatttgtatggtcaatagtattatgttgggctcaggattttggctgaaagttgaataaaagtacatagaaaaag

SEQ ID NO: 91843 - DNA, 435 bp, Homo sapiens
aatgtgtgttcctccagggtagaaatcagatttggagtcatagcagtagccagagaccctggttctgctgtcactagggcttaattctgttgtcagcaatcatcaggagagtagctccatcatatggcttcccagcctcatcattttgacttaaaaaggatgtattcggaaaaatagggggaagtatattcttctgatagggcagccataacaaaataccacagactggatataaacagtagaaagtggtccagattaaggtgccatcagggttgggttttcttcctgacttggggagggctttcttcctgacttacagatggctgcctccttactgtgtcctcacattgcctttcttctgttcacgtggagaaagagagagatcgctgctaggtcttcctcttcttatgaagatagcagttctactgaattggg

SEQ ID NO: 91844 - DNA, 479 bp, Homo sapiens
atgcgggtggatcacctgaggtcgggagtttgagaccagcctggccaagatggtgaaactctatctctactaataatagaaaaattagctaggcatggtggtacacgcctcagtctctgcaactgagacttttatttagttccagttctaaggatctgcctttacaaaataagcaaagaagtaaataaagttttatgcatacagatctagtttagagcaaaacattagaaatagcctaagtgctcacccgtagaagctcaaataagtatcagtacatcacatacactggaatatatccaaatgacaataaagcattaaaagtctcattaactaattaatcttatggaaaattgatcaaaatcaattaagtgataaatgcaatgtttaacaccatatttacaattacaatccaaattgtgtaaagaaaaaaaatgagatctggatgaaaatgtataaaataaaaatgaattttctctaat

SEQ ID NO: 91845 - DNA, 370 bp, Homo sapiens
tagtagagctgaataggttgttagcaatgacttataaatatccctgtgttattactactttctctgctggcagggtttagcccgggatccatggaatccccctgccgtctgcagacagacttcaggggcgggtcagcctcctgaaatgctgggctgtgtttgtgtgtttgtggctgtgagcatttctcaggcaggactgtcattagattcccaaaaggagcattaggttgtcaggcaggagcattcattagattcccaaaagggtctaagaatttaaaaaaggtgaaaaaaggtgacaaactactgatcaggtttaaagcctaccctcatccccagtacacatagcactcacacactcacatgcacacac

SEQ ID NO: 91846 - DNA, 319 bp, Homo sapiens
gtttgaagcacagaatatgagggaaaaaaagggaaaagaagaaaactagagcagcaaggggaaataagatcaatcttttataccatgcttcccttccctttacctttaggctaaaggcaaagtttaagaattgacatgacctcatctgacagaaatgggtgtgggtttttaataaaagtaacaggtacagggattttttaatggctgaagtccatttgctctcctatttcttggttaaatagctcttgcctggtcatttcacaagaattgcaaggcagagtggaaatgtagagaacaatgcaaacaccagtaatactaa

SEQ ID NO: 91847 - DNA, 386 bp, Homo sapiens
ctcccaattaattattttaacaagtgtgtgcagtgattcatgattttcttgatacttctcttcatgcatattgttcagtttttccactatattctttaacatgtcgatatggtttggctgtgtccccacccaaatctcatcttgaattcccacgtgttgtgggagggacccggtgggaggtaatcaaatcataagggcaggtgtttcccctgctgttctcgtgatagtgaataagtctcatgagatctgatggttctatgaaggggagtttccctgcacaagctctctctctttttgcttgctgccatccatgtaagatgtgacttgctcctccttgccttccaccatgattgtgaggcttccccagtcatgtggaactgtaagtc

SEQ ID NO: 91848 - DNA, 185 bp, Homo sapiens
tgagatggagtttcactcttgttgcccaggctggagtgcaatggtgtaatcttggctcaccgcaaccttgtggaagaaatttctaagcagcaaagcattcaagtgtgacctggctgcttctaacagcatatgttcatatgcatgcacaaataaatgacccaaaaccggaacttatatttaaaagg

SEQ ID NO: 91849 - DNA, 415 bp, Homo sapiens
ctcggcaaaaccgctcccacagaggccaccgactttttaccagttggatgcattggctcccagaaacccagccagcttagtgcacttctgcagccgtccttggagctgtgaacatacctggaggggtcagcaagaaactgaaatcaaattcagatcaaatagaagttaagaaatagaaatctcaacacacaggatgtagatctaaatactcacaaaatattgataatgcgcttcagccttctgtgccttgaaagaggttgttctctcgagttcctgatgtttcctcagggcctcagaataaaaaagggactgagaaaggaactagcatttttggggcacctgctgcgtatcccactgtaactaaagcatatcatttaaccttcacgccagctgagggtaggtattatcccacttg

SEQ ID NO: 91850 - DNA, 513 bp, Homo sapiens
taatgtcatcagttaaggcaggaaatggccattttcacttcttttgtgattcttcagttactttgggccatctggatgtatacatgcaggcttgggctcagaggcctgacataacagtcacgtggtaaaaaaagaaaaaaagtgtgtgttggtacagaagtctttttagaggtgcagtgctaagtatttttgccatcttttaacatttgaaatttacatttggtggctgtttacctattaatgcttattttaaattgaattactatgaatgtcttattattctgaagagcatcccatttttattaagaaaattcttgttaagtgtgtgagacttggcctctattagctgatatataaagaggaattaattgcaaaatttacctttggccctagcgctggtgagcaaggcaagacccaggaagcccccaggaacccccaccttcctattttgattctgtcagtgttgagagcattgagagcatcattcaagaatgaatgcattctggctgggcg

SEQ ID NO: 91851 - DNA, 373 bp, Homo sapiens
ctgccaagacttgcagtggcttctgtcactatggaaaccatgtatgatctctgacctccaccagggccaacttcagcctttaaaaccacctggaaataaggaagtgctgagttctagaaaatgtaactttctctttcatctgtatgtaaaaaggtagttgaaaaacagaaccgtgactaaatttagatcatttagccaatcttgatactagtaggggtttttgtataaaacacagtgtgttgttagcattttcttggaagttagcctttggtgcttccaggtaagagcaccaaatctgcttatctctagggttgggaataagaatagatgatattgcttccgttgtgagattttggtccaagtcgggctggta

SEQ ID NO: 91852 - DNA, 773 bp, Homo sapiens
cgcttgtccatgtgctgaaaagaggcacaaatgtccgaacctactgagaatcatgccagtgtaggatgagaacattcctaaagcctcagccctcgagggctacatatttgtttaaggaaaataaggcatgtgcatacactaatgaacaataaaatggaacagtgcaaggtatgattcggggcaatattttataaaggtcaagtacacataggtgggaaacacatctaggaactctcatgagcagggtgggaattaaatgttaaggtgggtgtgagtttatatataatacagagggggtgtattttgaagaagaaatcatgaaaaaaatcacatttagctgtcagccacctcctcatctgcatgttttgccaatcaaggacataaaatctatcattctgtgcttcaagtctccacatagtaactagaagacacagaaaattcttattcattttgaattctgataatttagtgcaggaaatgggtgatggcaaactgattatgtatgaagagccctcattttgctggtgaagcctgggtatgcccagctactaataacaagtggtcaggcaaccatgacagcctccctatgtgaatataatgctaaatgtatctaagcgaatttaggaccacctgttctgatttattttttaatccttcaaatacaacatggagttagatggcttctccatcaagacttcaatctcaaagggcaatactgtgcggcaaaagaagagctggctcctggaggacttctggggccccaggcatggatc

SEQ ID NO: 91853 - DNA, 523 bp, Homo sapiens
tcaaaaacagtgccacagacatgggaaaactcgacaaatattttatcagaacaatcaagtgatttgacttacagcaaaacacaaattagtgtgacttcagaaaatattttcatcatatcttggtcatattttttcatcatatataatccctagcaaagaaacagaggacatgcagaccatatgacatgaggtttcacattagcttgatttgacaaagatgcaaataatgcacagaccatctgtacatgagaaccagatgtctcatttgcatttggatttttccagtagaaatgaatgtggaggctttgagaaatgcattaaatttattttaattgacatagacttagaatgttgagacaaattattttccaggcatcaaatgcaaaggtcagtgtgtgcacttgaagggataaaaataacaatgaaagaagggcaaggcagctgaggtcggcactagaagcatctggaggatatggaaactataaggaggcagatattggaggcacagataaacacccaactt

SEQ ID NO: 91854 - DNA, 660 bp, Homo sapiens
attaaaaccatgtaaggccataaatctagtaatatgatacctgctcagagacttccttagcttgcacggaaaatgcatagacgttgccaacatctcctacgtgcatttctaaaataatacagttggccattgaacaacacaggtttgaacttctcaagtccaatgttatgcagagttttaaaaataaatatattggaaaattttttggaggtatgtgacaatttgaaaaaaacagatgaacctcatagccaagaaataaaaaaattaagaaagtgagatatgtcatgaatatataaaatatatgttggtagtctattttatcatttactaccataaaatgaacacagatctattacagaaagttaaaatttgccaggcgtggtggctcacgcctgtaatgttagtactttgggaagccaaggcaggtgggtcacgaggtcaggagtttgagaccagcctggccaacttggtgaaaccccatctctactaaaaatacaaaaataaattcgccaggcgtggtggcacacgcctgtaatcccagctactccggaggctgaggcagaagaatcacttaaacccaggaggtggaggctgccatgagccaagactgcgccattgcactccagcctgggcaacagagcaagactctgtctcaggggg

SEQ ID NO: 91855 - DNA, 1221 bp, Homo sapiens
ggatgagttcatgtcctttgcaggggacttgggtgaagctggaaaccatcattctcagcaaactaacacagaaatagaaaaccaaacaccgcatgttctcactcataagtgggagttgaataatgagaacacatggacacagggcgggtaacatcacacaccagggcctgttggggggtgggggcctaggggaaggatagcattaggagaaatacctaatgtggatgatggattgatgggtgcagcaaaccaccatggcacgtatatacctatgtaacaaatctgcacatgtatcccagaacttaaagtataatttaaaaaaacaaaagaaaagaagtctcaaaataattttaactcctacttcaagaacccaaagcaaaataaaccataaaaaagaaaaacccaaaataaatagaaaggagggaatattaaagataagagcagagattaattaagttgaaaacaaaaatcagtgaaacaaagagctggattttttaaaaacttcagtaaaattggcagacctctagcaaaactgacagaaaaggtgcaagttaccaattatcagtaacaaaacagaagctatcactacagattctccagacataaaagaggtaattagggaatgctgtgaatagctttacccacataaatgtgacaacttagatgactaatagaccagtttatccaaaaacacaaattgctacacccagccagtatgaaaaagttaatttgagcctgggcaacatggtgaaaccctgtctctactgaaaatacaaaaagtagctgggcgtggtacaggagcctgtaatcccggctactcgggaggctaaggcaggaaaatcgcttgaacccaggaggcagaggttgcagtgagccgagaggcaccattgcactccagcctgggcaacaagagtgaaactacgtctcacaaaaaagaaaaaaattgaatagccctataaactacaacggaaattgaattcatagttttaaaactccccaaaaacgaaacctctaggtccaaatggtttcactgcggaattctaccagacgtttaaaaaaggaatgaacaccaattctagaccatcttttgcagaaaatagatgtaacacttccctatttattttataaaactgattttactctgacactaaaaccaaagacaatacaaaaaaaggaaaagtacaaaccaatagcctttataaatatataagcaaaactcct

SEQ ID NO: 91856 - DNA, 242 bp, Homo sapiens
cgagcgcgaggatccccgttatttgccttctttatggtccaaatggtttcactgcggaattctaccagacgtttaaaaaaggaatgaacaccaattctagaccatcttttgcagaaaatagatgtaacacttccctatttattttataaaactgattttactctgacactaaaaccaaagacaatacaaaaaaaggaaaagtacaaaccaatagcctttataaatatataagcaaaactcct

SEQ ID NO: 91857 - DNA, 236 bp, Homo sapiens
gtctgagctcaggaaagaggtctggctggagtagtttggcgagtcaacgctgaaaagctgataacgcaagagatggagtgcgccgagtagaagggagctttctactgccaaggactgagttaggagaacggacagggagtcgctgaagccaagtgaggagagcggtgccagaggtagagggacatttttaaatccaatgcaagaaaaggaaaaaacaaaaaagctttccaactttc

SEQ ID NO: 91858 - DNA, 371 bp, Homo sapiens
  misc_feature (341)..(341): n is a, c, g, or t
ctcagcctactttttaagcagttgtttcctatgtacagaaatatactcaattattttaaatcgggggaaaaatcctcaaccacaagtaggaacacacccagcactccgaagaggccccttaattgacacattcacctccttagatatctcagctacacgtttgcctggggattgatttttggccattgtgcgacgtctagtgacatgaacactggatgtggaatgtgagcattccctttgtacgtatggtctgcgtggtgtgtgtgtgtgtgtgtgtgtgtgtgtgtgtgtttggcttatttcacttagcataatggtgaggaactgaagttttcattctnctggatattaatttctatttcaattgcccc

SEQ ID NO: 91859 - DNA, 767 bp, Homo sapiens
taataagtctggcattcctgcccttggcagtgtgagatggaagatgatgtcgcaagggtggccgagaagcagctgggctgagctgctaaaagcacagagaccggggccagactcctcagcctgaaatcctgcttccactaagtaccagctgggtaacttcaggtggagcccagttgacaggaaatgtttctccagaagctgaaaagctgcctggtaaaggcctttcataaaatggtctgcgtttgggaccaggaagacagaagactcctcaagaagagaactggaaccttaacccacttcagacttcttcatgtctgaagcttatttccaccatcccattgagaaccaaagaagcgagctccttggagaatcggctcccacctggaccttctgtttatccttccaatagctgctgcattcatccttcccagctaatgacacttccagcctttcgtgtttcaaagtatcacggactttgcaaaagattccaggtttctatggagcagatagtacttttaacaatcaacatgtgcattattatttcctcctaaggcatacttagacatcaatgcatgctacagcaaggcaacttatctcaccctcaccaaggtatgaacttcagaatttgaacttgttcctttggggtaagttgtatcaccagcactcactaacagactgtattttccagtgaggtttcattctgtttcagatattctgcactttcagtggcaaaattttaaagaaaaggagacaaaatggaacacaaa

SEQ ID NO: 91860 - DNA, 364 bp, Homo sapiens
tatctcagagatgaatgtcacctgggtatctggtctcacctttcccccaggctatctaaacagaccggcctaactccagaggtaatgagttcatcaccatgaatgtgcaaagcacagtaatcatgattactttcctatgtaccaagtattagaccaagtgccttacatatagaatctcaattcatcctctttaaattccaggcgagaagcataaaatgattaccactttacgatggtaataattcattgggggatatcatttattgctccccacccaccataccttggtcagataaagatctagaactgagcttaagggaaacagctgtctctcacctcccctattcctccccagacccagcaa

SEQ ID NO: 91861 - DNA, 393 bp, Homo sapiens
ggcagggagctcagtggtagacacaccggtcatcatgctggtgtgggaaagatttcaaagcctggccatagctcccactgaagctcctttctgcaccttactgcttccttgtacaagtcaaaccagggcctttagagcagggaccttcattgcactgccctctcctcgcctcccaaatgataatatccagctttcaaggtctgcctgatgtcccagggttaggagggcagagaccaggcagtttatgtcatgtcacttcttttttttttttgtcttttaaaaaatttattatactttaaggtctggggtacatgtgcacaacatgcaggtttgttacataggtatacatgtgctatgttggtttgctgcacccactaacttgtcatttacatt

SEQ ID NO: 91862 - DNA, 270 bp, Homo sapiens
ctagttgatagtccatatctaatatataatgaatgtacagttgtttctgttggagttcacatatgatgccttgtttcctttgtagttttgtgattgatagcttcgaactgctcatttaccttgaccttttgaattctttgaaaactgagttaagtctgattttccagagtttttatgtttgcttctgtcagttgcagagaatcaatgagaagaacactttaaattcttgttttcggtttttttccaatcacataagtaggatttacctga

SEQ ID NO: 91863 - DNA, 400 bp, Homo sapiens
ctttcctttactctgcaaactgcccttggtcattcctgggcttggaccaagctaactttcaaagaaatttggattatagtttaagttataacagcccttccccaaaactaaaccagctttgtaaaactaatgaaagacaccacattagcaggatgagaggagcctgaattctgctaagatgtaggcgtaaatgattgccagccattattcaagaggtcacaagatttgcaactgccccagttactcctgcagataacatcactattataaaatcaaagactggcttttggttttacaaaacccaatgagatggcttttgtaagataatgtcctttgaggcttttgcatttctgatgacccaagacccaagaattttgatttaactgctcctctggcccat

SEQ ID NO: 91864 - DNA, 136 bp, Homo sapiens
cgatctcctgacctcgtgatccgcccgcctgggactcccaaagtgctggggattacaggcgtgagccacagcgcccggcctgagtctacagctttttaaaatctgaattcagttactttctatgtggaaaagaatg

SEQ ID NO: 91865 - DNA, 409 bp, Homo sapiens
tttcataatatggttaaaaagccctagtaaatcttctcttagaagatttcttacattcaccctttcctttcagttttcacatcactgccctgtgaaacactcatgttcagggcctctgtctcaggcttggactggttttaagatcttcctcattgccctaagtctctctcttccatactatacttcatatttttgtgatgttgagcttcctaaagtactctaaatataagccttcatctcttaaaaagctttgaaaggaatatgacctaaaagatattaataccctaatactccgtaaaatcttcctagttgtaggaagatctagttatatactagaaaactttatttcagaagacatgtatagcctacatgtaaaagtttttagcagcactgtaatagtaaaacactg

SEQ ID NO: 91866 - DNA, 565 bp, Homo sapiens
cacaccttctagaagcagactctatgaattcaaatcctgggtctaccatttataagctgtactttcctctgtaaaatatgaatctacagtacctacttctcacagattgttataaagatgagatgtgttaatatagataaagtaagcactcagtgaatatgaggcattaaccagaacccaacaaggtgccatcatcaaatataataattgagtgcataacttttttcagtttacaaagcaaatttacatatagcatttcttttggatctcacaaaactccatgagagctggcaaaatacttccccccattttctttgaagctcatactctccttgtttactcccttacaagtcacacttgaacaaagtgaccaggcagatttgggaaaaagcaaacaaacaaaaaacaccagatagacctttaagaaattaaaaaacaaaaaacaaaaaacaaaaaactgttaacacagaaatctcagttgatgggctaaatggcccatcattctaagaatagttgggaagacaatgctttagatgccatctacacgctgttagttccatctcag

SEQ ID NO: 91867 - DNA, 420 bp, Homo sapiens
ggctagagatcgggtttgaggataactgtaagataactgcagctgccacagagacgctgacgtttagaagatgaagaggggaagcatgcagcccagttaggaggcccctgatgacctgaatcagtgaggcagcagtagagatggaataaagcacgtgactctaggacgttggtggaagagtaaaaggccttaccaggcagttgagggcaataaaaagtgagaccccaaggatgccgcctaactttttgtcttgagtaactgggtggatagtgccatctactgaaatggaagaaatctgaggaaagaagatggaaggagaaaggaagggaatgaagaatttccttttagacatgttaaattcaagatgtttcttgaacatccaagtgtgataccatctggagatacgaatctgagcactga

SEQ ID NO: 91868 - DNA, 297 bp, Homo sapiens
aacaagcaaacttcatactgatggggataaatcaaaggagcataagagccaactgaaagagctcctagtggacaaaactttgagcgtaaagaggactttttaaaaaattgaccattaaaataaacgaagtagtattgcattacaactaagagtgtaaaatatcaataagtccatactgatagaaataaatgactgaataaataagtaaatgggggagaacagacaaatctctgtgcagaagaacttcaaatactttacacagataatctgccatcaaggagagtgagccttaactct

SEQ ID NO: 91869 - DNA, 163 bp, Homo sapiens
aaataaattttactctgttgctggcttttgaagaaaatcatttagatattaaatctatagatagaacatttctctgcctcatgtaatattttattcttagttaaaagttttgaggtataaagtaatgcattgtatttctttgtatatcctcccagttatagat

SEQ ID NO: 91870 - DNA, 478 bp, Homo sapiens
cttacaaagtaatataaataaaataagacatttaaataacatgtagaagcaggagcagagtaggtatgattcaaaataaatactaaatgattaattggacaagacacacagtaacaaatgaagtgagaaagcattacagtgatggaaatattagaccaataaattctgtagagtgaatcatcatatcacgtaaagtgaatacaatcactgatgtagcaggataaggaactattacattgcactgatattagatcaaatctcggctctgccaattattttaactttagacatgcaattttgccttttcgtaccaatgtttttcatcttaaattaaactaattcctactttgtatagtgttgcatgtttaagtaaggtgatatatttgaaagcaccagacagattcaaactacaatcactgttgttgctgtcgctgttgttcatttcacttttactatttatatccaattatcatattcc

SEQ ID NO: 91871 - DNA, 593 bp, Homo sapiens
tctcaagcccattccctgcagctgaggtggggctcaggctgtggctcctgcagccatgtgggagaggctgataggactttcctctctcccattgctcagcaccctccagtgtgtcatgtggagactcacctgggaatgcaagtggccaacagtagtgaagaggatgagcttgtgtggtcaaaatgggatgtggatgtgaaatttatcctgtgctgtgcaaagtaccacagagtgagtcaccttcctcaccagtagtgttagaaagaggctgtgaaagttgtcagaatcaaaatagatccacttgtgttaaaaccctgacaaatggaactaggaatgaccatgaaggaggtttcccatgcacatactcctgataacaagaacgaccatgaatggattctgcttaaccacaacctttgatagaagccaccatgaccttataaaaatcacatctacaaggacatcttcccagcaaatcactgtttaaccctatattgatgccaaccttggtattgactctacaagcaaggaaaatactctcaaaacaatttatgtaacccacctcattttcactaataaacctatggattgacatc

SEQ ID NO: 91872 - DNA, 209 bp, Homo sapiens
tacaaacacctgtcttatccatagccagaccaaattctttacttttctgtacctttatagcatagaactatttttagcacttgctgaaggatagttagaataaagttatatgacttaaccaggtctgagtatcacttccagagtactaaaaacgtttttcaaaagtactttatcagaccatagtttcacccgtatgttgaatataacaa

SEQ ID NO: 91873 - DNA, 616 bp, Homo sapiens
aactgcattcagggcaaatattagttggtttgccgtcagttgccattcacatgttcctgtccatttggaaggaattgttcctggctttcaaaggtgagacatccactgcttgaaagttggttctttattagcaaaaaccaagcttcctggccatgattagtactaccacccctaatacccaggtgtattagtcagttcttgcattgctataaagaaatacttctgaaactaggtaatttatcaagaaaagaggtttaattgactcacagttatgcaggctgtacaggaagcatggtggcatgagcttctggagaggcttcaggaaacttacaatcatagcagaaggccaagggaaaacagtcacatcttacatggccagaccaggagcaaagggaggtgccacacacttttcaatgaccagatctcagggtagcttgctcactatttcaacaacagcaccaaaggtggatggtgttgaaaccatgagaaaccacccctgtgatgcagtcacctcccacaaggccccatctccaacttggaggattacaagtctacatgagatttgggtggggatgcagatcgagatgatatcaccaggtgtcaggaggagaggcaa

SEQ ID NO: 91874 - DNA, 241 bp, Homo sapiens
ggctggtgctggaacgtaacaggacaaggtaagcaaaggtatctgacacacacccaaacagctgggaaaaagggggagcggggcaagagctttcctgacacatttggtcctgtacaggatagggttcgcagtcttctggagcatcaaaaagaagatactgtgacagggatacagaaaccaaccaggtgaccaaaggtggtagatcactccagaaaaacgtggtataacaaagcaaccaatc

SEQ ID NO: 91875 - DNA, 565 bp, Homo sapiens
ctttaaatcataaatgttggtaattgttaatgtattatgtgctaaaaataacaatggtaacacaggcgataacattgtatattctgctttaaaattttcagactacttttacatctgttaactcatcgtatcaatcaataaattaccttatctgaaatggaaatttgttcaagctgagtaacactgatcccctgaatatttccccaaatgccatctactttcaccatccagaatatgtattaagttttatttggtttcatgaagaaataagtacttttagtttccctctttctcattagcatatctttgaattatctatgtaatgttcaatactctgtgcagatctgttgatgattaggacctgttcatttgaaaccaacaaaccaaccaaccaacaaacaaaatctgtcctaagaaggctacacaaatttaagagatgcacgagtttttctcactagtgttagcataagacttttacagacatccaaatttttcatgtaggtgagtcaaagggattgactggagtgactttgttactgtaaaaagagaccttttaaaaaaaaaa

SEQ ID NO: 91876 - DNA, 308 bp, Homo sapiens
acctacaaactagtagatcattctaaggttagctggttggcttctttacactctggtcattctatttgcgaagtgtagtagctgatatttaggggcctagcattattgatagctcatccctattttcctaggaggtaggtatggggaatgaattagtaaaggtgaacttaaaattctcatccacaaacatgctagcctaagctccaaattaaatgtaaccaaaaccgtgtggttttccccaactctgttttattcccaagatttgttgtccttgtattttgaaaacggggaaggagaacttttaaatt

SEQ ID NO: 91877 - DNA, 1951 bp, Homo sapiens
  misc_feature (1071)..(1071): n is a, c, g, or t
  misc_feature (1944)..(1951): n is a, c, g, or t
ccgccgccgccgcaaccccagcctccccagcagccgtcgccgccgccacagcagccgccgccgccgccgccgcagccgccgcagcagcagcagccgccgccccaggccccccccatggagcccgaggccccggattcccgcaagaggcccctcgaaacgccccccgaggtggtctgcaccaagcgcagcaacacgggagaggaaggcgaatacttcctgaaggtgctgatccccagctacgcggcgggctccatcattggcaagggcgggcagaccatcgtgcagctgcagaaggagaccggagccaccatcaagctctccaagtccaaagacttctaccccggaaccacagagcgggtatgcctagtacagggcacggcagaggccttgaatgctgtgcacagctttattgccgagaaggtccgagaaatcccacaagcgatgaccaagcctgaggtggtcaacatccttcaaccccaaaccacgatgaaccccgacagagccaagcaggccaagctgatcgtccccaacagcacggcgggcctgatcatcggcaagggaggcgccacggtgaaagccgtgatggaacagtcaggagcatgggtgcagctgtcccagaagccggagggcatcaacctgcaggagcgcgtggtgacggtcagcggcgagcccgagcaggtgcacaaggccgtgagcgccatcgtgcagaaggtacaagaagacccccagagcagcagctgcctcaacatcagctacgccaacgtggcaggccccgtggccaactccaaccccaccggctctccgtacgccagccccgcggatgtgcttccagccgcggccgcagcgtcggccgccgccgcctccggcctgctgggccccgccgggctggctggcgtgggggcctttcccgccgcgctgcccgccttctcaggcaccgacctgctggccatcagcacggcgcttaacacgctggccagttacggctacaacaccaactccctgggcctgggcctcaactcggccgcagcttccggcgtcctggccgccgtggccgccggggccaacccagcngccgccgccgccgccaacctcctggcatcctacgcgggcgaggccggggccgggccagccggaggggccgccccgccgccgcccccgcctcccggagccctggggtcctttgcgttggccgcagccgccaacggctacctcggggccggggcgggcggcggggcgggcggagggggcggcccgctggtggccgctgcagccgcggccggggcggccgggggcttcctgacggcggagaagctggcggctgagagtgccaaggagctggtggagattgcggtgcctgagaacctggtgggagccatcctggggaaggggggcaagacgttggtggagtaccaggagctgacgggcgctcgcatccagatctccaagaagggcgagttcctgccaggcacgcggaaccggcgggtcaccatcacgggcagccccgcggccacgcaagccgctcaatacctcatcagtcagcgggtcacctacgagcagggagtgagggcctcaaacccccagaaagtgggatgaggcctgtggtgtgtgctcccacccttttctctcctcccatctcctcctcttccctctcctcctcccccccaactcctgacctcagcttggtgtagtcctgctcctcttgggatggggctggggtaggcccgactgcaccctccccttctggtagtcataggcaggattgagtgacggttgggaagggggctcagaagccccctccccagcccggaactgacccctccttcctccctccctgtgcttggctgggcctgacccttcctgtcccagggcccaggtctgtgtgatatctgtatatattgcattttgttgattttaatagaaaacaaagcgttattttctctttcnnnnnnnn

SEQ ID NO: 91878 - DNA, 2101 bp, Homo sapiens
  misc_feature (1221)..(1221): n is a, c, g, or t
  misc_feature (2094)..(2101): n is a, c, g, or t
aaattggcctataacaaagaatggccaaaactccacaagctgccgctggcactgcatctaggtcttcgaggctgtccttcatcgtgttggtccccccaggagtggagggtgttaagcaatgatgggaggagactgaatcagaattggatttgaatctgagcccagtagctgtgttcgtgtccttgggctggtgatgaccgtgggctggtaccttcacttctctgtgcccctctgtgcctcagtttcctcttgtgtaaaaatggagctcattccacccgcctcaccgggaggttgtgaggaacggacgagatcaagctcacaaagcactcagcacagcgcctgatcaaaaaggaaggcgaatacttcctgaaggtgctgatccccagctacgcggcgggctccatcattggcaagggcgggcagaccatcgtgcagctgcagaaggagaccggagccaccatcaagctctccaagtccaaagacttctaccccggaaccacagagcgggtatgcctagtacagggcacggcagaggccttgaatgctgtgcacagctttattgccgagaaggtccgagaaatcccacaagcgatgaccaagcctgaggtggtcaacatccttcaaccccaaaccacgatgaaccccgacagagccaagcaggccaagctgatcgtccccaacagcacggcgggcctgatcatcggcaagggaggcgccacggtgaaagccgtgatggaacagtcaggagcatgggtgcagctgtcccagaagccggagggcatcaacctgcaggagcgcgtggtgacggtcagcggcgagcccgagcaggtgcacaaggccgtgagcgccatcgtgcagaaggtacaagaagacccccagagcagcagctgcctcaacatcagctacgccaacgtggcaggccccgtggccaactccaaccccaccggctctccgtacgccagccccgcggatgtgcttccagccgcggccgcagcgtcggccgccgccgcctccggcctgctgggccccgccgggctggctggcgtgggggcctttcccgccgcgctgcccgccttctcaggcaccgacctgctggccatcagcacggcgcttaacacgctggccagttacggctacaacaccaactccctgggcctgggcctcaactcggccgcagcttccggcgtcctggccgccgtggccgccggggccaacccagcngccgccgccgccgccaacctcctggcatcctacgcgggcgaggccggggccgggccagccggaggggccgccccgccgccgcccccgcctcccggagccctggggtcctttgcgttggccgcagccgccaacggctacctcggggccggggcgggcggcggggcgggcggagggggcggcccgctggtggccgctgcagccgcggccggggcggccgggggcttcctgacggcggagaagctggcggctgagagtgccaaggagctggtggagattgcggtgcctgagaacctggtgggagccatcctggggaaggggggcaagacgttggtggagtaccaggagctgacgggcgctcgcatccagatctccaagaagggcgagttcctgccaggcacgcggaaccggcgggtcaccatcacgggcagccccgcggccacgcaagccgctcaatacctcatcagtcagcgggtcacctacgagcagggagtgagggcctcaaacccccagaaagtgggatgaggcctgtggtgtgtgctcccacccttttctctcctcccatctcctcctcttccctctcctcctcccccccaactcctgacctcagcttggtgtagtcctgctcctcttgggatggggctggggtaggcccgactgcaccctccccttctggtagtcataggcaggattgagtgacggttgggaagggggctcagaagccccctccccagcccggaactgacccctccttcctccctccctgtgcttggctgggcctgacccttcctgtcccagggcccaggtctgtgtgatatctgtatatattgcattttgttgattttaatagaaaacaaagcgttattttctctttcnnnnnnnn

SEQ ID NO: 91879 - DNA, 1467 bp, Homo sapiens
  misc_feature (587)..(587): n is a, c, g, or t
  misc_feature (1460)..(1467): n is a, c, g, or t
gaccctcccttttgctccccacgcaggccaagctgatcgtccccaacagcacggcgggcctgatcatcggcaagggaggcgccacggtgaaagccgtgatggaacagtcaggagcatgggtgcagctgtcccagaagccggagggcatcaacctgcaggagcgcgtggtgacggtcagcggcgagcccgagcaggtgcacaaggccgtgagcgccatcgtgcagaaggtacaagaagacccccagagcagcagctgcctcaacatcagctacgccaacgtggcaggccccgtggccaactccaaccccaccggctctccgtacgccagccccgcggatgtgcttccagccgcggccgcagcgtcggccgccgccgcctccggcctgctgggccccgccgggctggctggcgtgggggcctttcccgccgcgctgcccgccttctcaggcaccgacctgctggccatcagcacggcgcttaacacgctggccagttacggctacaacaccaactccctgggcctgggcctcaactcggccgcagcttccggcgtcctggccgccgtggccgccggggccaacccagcngccgccgccgccgccaacctcctggcatcctacgcgggcgaggccggggccgggccagccggaggggccgccccgccgccgcccccgcctcccggagccctggggtcctttgcgttggccgcagccgccaacggctacctcggggccggggcgggcggcggggcgggcggagggggcggcccgctggtggccgctgcagccgcggccggggcggccgggggcttcctgacggcggagaagctggcggctgagagtgccaaggagctggtggagattgcggtgcctgagaacctggtgggagccatcctggggaaggggggcaagacgttggtggagtaccaggagctgacgggcgctcgcatccagatctccaagaagggcgagttcctgccaggcacgcggaaccggcgggtcaccatcacgggcagccccgcggccacgcaagccgctcaatacctcatcagtcagcgggtcacctacgagcagggagtgagggcctcaaacccccagaaagtgggatgaggcctgtggtgtgtgctcccacccttttctctcctcccatctcctcctcttccctctcctcctcccccccaactcctgacctcagcttggtgtagtcctgctcctcttgggatggggctggggtaggcccgactgcaccctccccttctggtagtcataggcaggattgagtgacggttgggaagggggctcagaagccccctccccagcccggaactgacccctccttcctccctccctgtgcttggctgggcctgacccttcctgtcccagggcccaggtctgtgtgatatctgtatatattgcattttgttgattttaatagaaaacaaagcgttattttctctttcnnnnnnnn

SEQ ID NO: 91880 - DNA, 1139 bp, Homo sapiens
aaattggcctataacaaagaatggccaaaactccacaagctgccgctggcactgcatctaggtcttcgaggctgtccttcatcgtgttggtccccccaggagtggagggtgttaagcaatgatgggaggagactgaatcagaattggatttgaatctgagcccagtagctgtgttcgtgtccttgggctggtgatgaccgtgggctggtaccttcacttctctgtgcccctctgtgcctcagtttcctcttgtgtaaaaatggagctcattccacccgcctcaccgggaggttgtgaggaacggacgagatcaagctcacaaagcactcagcacagcgcctgatcaaaaaggaaggcgaatacttcctgaaggtgctgatccccagctacgcggcgggctccatcattggcaagggcgggcagaccatcgtgcagctgcagaaggagaccggagccaccatcaagctctccaagtccaaagacttctaccccggaaccacagagcgggtatgcctagtacagggcacggcagaggccttgaatgctgtgcacagctttattgccgagaaggtccgagaaatcccacaagcgatgaccaagcctgaggtggtcaacatccttcaaccccaaaccacgatgaaccccgacagagccaagcaggtcagctggggcagagactgggttgctgtaaagctgttgacattcacaaagaaacattcctcccacatcactgcttactgtgaggttcaatgggacaaagctgataaaaatctcatcagtcaaagaccacatggtagtggttagtattatttttagggagtcagctctaatagaatagaaaggactccagaacatttagagtgggcttgattcagagagggagtgaaggtctgggagaatgtggcatgattccctattgttcgatcctttcttcctaggattctctagttcctcttctctcttccacctcatcccattgtctctctgaacgacctgcctcccacttcctgctatcaccggaagtgacctcagtgacagttcagccacatccagaagagtttacaaatggcctctcatcctccttccctccataattaacgtatgggggtagaggtggtgtttcattagcgagagaagag

SEQ ID NO: 91881 - DNA, 380 bp, Homo sapiens
ggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgc

SEQ ID NO: 91882 - DNA, 259 bp, Homo sapiens
cgaggaacagatatccaggactgtggtataagccagcgatccactaattcggtgcgggaggtggccacctagagagattgtgcagagatagcacagcttccctcacagccctctgcttagccatgccacctggaggagcaggtgtggaggcacacagcgatgaggaccgtggcctccacatgttggatgccacattcacgatgtccatttgagttttttaaaagtttgccccctcatgtgattgttcttatgacctttg

SEQ ID NO: 91883 - DNA, 391 bp, Homo sapiens
aggcctggggtgacaaaaatctgggttggggagatgggaggctgaccatgtgctcatcaaagccggccaggcggatgagtttttcagccactgctgccgtgcgtgggtcccgctccacagtaagaaggcgacccccagggggcagggctcgggcaataagcagggtagagtatccacagtaggttcccaattccagcacacaagcaggggccttctcctccaccagccgcatcaggatctgacctatgaggggagatggctgttgcagaagacatgggagatggatgcagggcccctgataaaagatatctcaaatgcctacctgcctcactgcagctcccaaccagccggggtctcatctgtctcttgtaccatagccccagctgccctc

SEQ ID NO: 91884 - DNA, 674 bp, Homo sapiens
tgtgttttagatctcattcccttctttttctacatttgttccattgtctaactaagagactcagggcatcaggcaagtcatgtcagaaaggttggctttagaagccacatcccagaattcctaaacttaatcatggaaggagggggcagactgacaacgcattccctatgtcctctaaagagatttctcccgttgggattgctttatccccagaggtgtgctgtagaaccagcctgtgttcacagtaaatctctgcttccgcaacagcggtgagctctcagccctccctgccctggtcttgtctctagggcctgtgggtctttgtggactgatggtgtgggtgggtttctgagggtctgcatggactcatggtgtggatgggtttctgagggtgttggtagcagtaacggttccacatgatgaaacccagatggctgctccccactgtgcatccacccggattcacccgctgctttgctggctgatgtctacaaggacatagatggcctgcatctggcgggggctgcaggagagctggcaggacatggggccattagaagaggtgtgagactgtcatcagcagtaaaaagtggaacagcccagggagccctcttgtgagtttatggcttaaagtccaagtacaacttcgtttgaaagaaatgccttcctcctga

SEQ ID NO: 91885 - DNA, 1437 bp, Homo sapiens
cggccgccgggcccggcgcgcggcgccgccttcttggagagcggtaggcgcgggagcgcggcccctccgaggtccgcccgcggccggggagctgcctggcacccgcggcttccaaaggggaaagaaagttgcgcccgcgccaggcgcagcgcgctcggcggacgcggcctttcgggcgaaagttaggaggggccgggctggcgggcgggcgggttccgggggctcctttccgcaccagcggcggtcgctccccgtgggcgggacctcgggcgtgatcgtcgaggagaccgcggctccctcacctgccggcttgttcctcggggtccgcggagcgagcccagctctcggcgcgtgtcggagtctcccagccccgcggccccgagcgcacgatgcgcggacccgggcaccccctcctcctggggctgctgctggtgctgggggcggcggggcgcggccgggggggcgcggagccccgggagccggcggacggacaggcgctgctgcggctggtggtggaactcgtccaggagctgcggaagcaccactcggcggagcacaagggcctgcagctcctcgggcgggactgcgccctgggccgcgcggaggcggcggggctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaagtgtttgttataatgacta

SEQ ID NO: 91886 - DNA, 932 bp, Homo sapiens
caaagctttcccaactgaaaaggaagcatccaggctccttcatggccctgcccagagtggtggcccacggggaatttcccaggaaagcatgaaagcgtctaatgcttttgtgacacaatcaggtcaaacatgataagaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaagtgtttgttataatgacta

SEQ ID NO: 91887 - DNA, 845 bp, Homo sapiens
gaagtttgcttggcagagtctttccctgggattcttaccctacaaaccagaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaagtgtttgttataatgacta

SEQ ID NO: 91888 - DNA, 774 bp, Homo sapiens
ggtatttttaaaaatacaatagactacactttttggatcacagagaaatacagatgcactctgagactgcctatgtttataaacatgttgtgtcccctaactgaagtgacaggtcttctggaattgacattaagaagtgtggatagtcatatcacacgcaatgtatttgttttcagcagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaagtgtttgttataatgacta

SEQ ID NO: 91889 - DNA, 461 bp, Homo sapiens
cctgcagattagactccgtattgcttccagggaattcagatatttgaagaaataaatggctttagtagctgatatacttgcaaaaaaatgcgatttatttgttttttaagtaactgacaagagtctgatatattttcaccgtagactataaaagatgcgccaggcttcttacccggctggctgtcagtccagtgtgcatggaggataaggtaagcttggacagacacacactggagcacataccaaagatgggaatcccgcttgggacatgaaaaattcatgggagtttaggaacactcattctttggctgaagtagccatattctaagtagagatggcacaacactcatctcacagtgctgaaagccaccctactggcttgtctacagggccccggcagctgttgttaactgctcactgcatggcacacgggcactaagtgggtcctgctctgaaacaca

SEQ ID NO: 91890 - DNA, 889 bp, Homo sapiens
cgcctgacgtcggcgggcgcggggataagaagctccccgaggtctgaggcgggactcggagccggcgcaccccaggtcggccgtgggtccagcgaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaaaaaatatttctttagaaacataagcagaatcttaaagtatattttcatataacataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaagtgtttgttataatgacta

SEQ ID NO: 91891 - DNA, 1383 bp, Homo sapiens
cggccgccgggcccggcgcgcggcgccgccttcttggagagcggtaggcgcgggagcgcggcccctccgaggtccgcccgcggccggggagctgcctggcacccgcggcttccaaaggggaaagaaagttgcgcccgcgccaggcgcagcgcgctcggcggacgcggcctttcgggcgaaagttaggaggggccgggctggcgggcgggcgggttccgggggctcctttccgcaccagcggcggtcgctccccgtgggcgggacctcgggcgtgatcgtcgaggagaccgcggctccctcacctgccggcttgttcctcggggtccgcggagcgagcccagctctcggcgcgtgtcggagtctcccagccccgcggccccgagcgcacgatgcgcggacccgggcaccccctcctcctggggctgctgctggtgctgggggcggcggggcgcggccgggggggcgcggagccccgggagccggcggacggacaggcgctgctgcggctggtggtggaactcgtccaggagctgcggaagcaccactcggcggagcacaagggcctgcagctcctcgggcgggactgcgccctgggccgcgcggaggcggcggggctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttatttaaaaaaaaaacacaaaaggaatgctccacatttgacgtgtagtgctataaaacacagaatatttcattgtcttcattaggtgaaatcgcaataatttgatattctgtattactttcactgttaaattctcagagtattatttggaacggcatgaaaaattaaaatttcggtcatgttttagagacagtggagtgtaaatctgtggctaattctgttggtcgtttgtattataaatgtaaaatagtattccagctattgtgcaatatgtaaatagtgtaaataaacacaagtaataaatgaagtgtttgttataatgacta

SEQ ID NO: 91892 - DNA, 726 bp, Homo sapiens
aactataggaagtctctcttagtcttcctttcagtcacttgttttattaagacagtaaaacactctgatccagaggttttaaatagagatgctttgttttcaattaaagttgaagatttaagttatttaaaactgaaccgtaattattgaagggaaggagagtttgagggcctattcaaagattcgtagaaaattcccattttggtgtagtagtaccattaaataatgcatatctaatgtgcataaatacttgtctgcagaaatcatgtctgctataaataggtgtcagacatggagaaatgcaggtccttcatgggtgggaacagccttcggtggtgttcctgggcttctcttgtatgtgttaatgacacagccgtgaaagtatcatttttcactttcgactgtcgaagcccagcttatattcccatatgcttttgtgtgtctttgtagagcactcttagggtggatttttgcaatttcatcacttttcttactctgccttcaggggccagaaacactgaagtttcacatgtgacctgtacactcttacagctcttatacatggctgaggggccaggagaggaaaacaccacagtccatttgtcaggaaaaaaagacacacatggggaaaaaggtcctgaaaagacccactttacactcttcatagtgattacttcaggaggattataagaaataatattaatatggaatatggcctgtgtacta

SEQ ID NO: 91893 - DNA, 390 bp, Homo sapiens
tcatttgtgttatataccagaacatttttatttctatggttttaatgccacctaatatgattatcaatgtgtcattctccataaatcattgtgttatacatgttaaacgattaggtattaagtgtataggtataaatcacttagaataatgactaacacattgtatgaactaaataagtactgattcatctgattcatcaaatttccattattcataccattcattatttattaagtggtgtagtatttgttcttatcaacatttgcttttctgtcctatctaaatattaatgaaacagtggatgtgggctcagtgtgctgtcttgaaataatccaaagtcaaatggcatgcttcactggtttcctttagatgcaataactcatttgact

SEQ ID NO: 91894 - DNA, 158 bp, Homo sapiens
atgttattatctataggagcaactggggaggttagtaattttgtggcctctgattgcatgactcctgagccacaatttctaatcttgtggataatttgttggttttacaaaggctgtctctcagcaaagagggggtttgcttgggggaagggctgtta

SEQ ID NO: 91895 - DNA, 320 bp, Homo sapiens
cccaggtgggtttcttttaatgtttgttttaatgatgatttttttttttcaagagatggggtctcgctttgttacccaggctggtctcaaactcctgggctcaaataatcctaccacctcagccttccaaaatgctgattataaaatgacattacaggcaggagccaactgcacttggcctggatgttttctttcttttttttagagatgggggtctcacctcagtccctgaagtagctggcattacaggcctgtgccactatgtcgagccaataatggcatagttttctaagcaaagaataatttcaggatccttccaa

SEQ ID NO: 91896 - DNA, 283 bp, Homo sapiens
ttgtattactactcttgtgctgtgagctgtgttactctgtgcctcacctggcacagccttggagacctggatgctaatcaggccgctccttgtctttgaggcactcacacattctctgggaggggcagaagctcgggctggcatgtaccctgtgtcttagtttatcatgcctgctctagcctacacaagagagaaatgtgtggtgagagaaatgggcgcacagtgatgaggctggggtctgcctccccaggccccagccttgcccactgttctgggctcacgc

SEQ ID NO: 91897 - DNA, 632 bp, Homo sapiens
acaggcagaagaatgaggaacatctttcaggcaaacgtcagcgcatgagcactagccaaaaatcagaaatgacctgccacaggtggggagcattcaaatggatttttaggtgcagtctgttaatcaatgactgtgaatgccagctggaacctggataggagctatatagtatagcactggaaaacaagcagagctttaagaaatataaacatggctgggcccccctcctgcagattctatttcaagaagcctagagtgatacccagggatctgtatttagaaatcattcccaggtgactttgatctccacccctagtgcaaaaccatattaatgacatcatatgaaccttctatcttcccaatgagcttctcctagcaagcaaggacaaagtacttgacggagtccctcatggagatgactaacaataggaattgctttagattgtttagcgtggtgatgacttaaaggatgagagagctaagcaagattaatctgacagcaggttcaggaatgaattcagaaaggagaaaacactggcaacagcggcagtgaagaagcataggcacacagtgtggatagtctcagtaaggattaaggcagcaggcatgaaggagactaaataggaagaatt

SEQ ID NO: 91898 - DNA, 1989 bp, Homo sapiens
attttttatgaatatttaaaattgaaaaagtttatttatctttgaatatatcacaagtatactcaactggcaatattttttttaattaggtaaaatgtacaaggtgtatcttcccacaaattaatgaaactgattttgaacaaacaaaattgacacacagatacattttctaagtgatgcacttttccaatgatgtcagcattactcaaaacattttttagaatataaacatataattgattttataattgctgtcagaaacaaaggcacattcttttactgtcccagaacattcaagatgctttcaatttattacaagtaccaaaagcagccacaactcaaatggctcaagcagttaaaggaattattctttcccataaaagcggtcctgaggtagggctacagtggctgaacttctgctatgataagtattcaggggtttcccaggacacagcatcaatgctaaaactggcaaaatcccaatggactgatcccttcaatggatgacaggaccctctatggctgaaagactctaaagttcttagttcttagctgtgacaggacagagaaccgacatgtcccacctgcagccacacccatccccttattattactagatcttatcaaaagctgacttgaagaggaaaaaaggccaaaagacttcttttcttcacctaaccgccgatgccctccttttggttttatggttccaacctgacagctactctgggctacaaagagccccttcttgacagatgactgccagctgcaggctagatcagactggtctctggagattgcacagatcgtgaacttgtgccctatgtttcacctttttgcatttacagcctaattataatacatttaaatgttaaatcttcaccccagagtgaacacaggtcatccgcttttggatattcttcatatgtaagcccagtgcgtgtctctaacgagtttcctccatgaattttcataggcttctcctgtatgctacagaatacgtatatcctacctctccacctagcataaatacctaccttttctccttcaaagtatgctttatggcctcaggtagaggcctgcttcctgcctgcaagttgtaacctcttagaaatagttatattttgtttattttgattcttttcagtcgacacatgcaaacaggaacgagttggctacttgagggttggttccttgtgcatctcagtgagtcttgaaaaaccccagatccgtccttccttcctgccgcatgtcatcctaaggccagtgtctgtcagggaggcaaggcagcagcagtacttttgggaaacatccagaataacattaaaaagcccctttttccccacacgtgtcttttatccagagggtctgttttccacaagttcttcagtgatttctccccagtctcattggctgggattggctttcacgcctcttaacaggattgaccatggttcatcaagggtcaacttgaaagctgaaccctgccaactttccctgaatctcctgactatggtggaggagtgtggatcctggaactaaactgaggtgatagggaggaaaagagagaaatcaacagtaaacgctgcacatcctctgtctggtaaatgtgcatcactgattgtatccaatctagattcaaccagagagacggaagcattaagaatgacatagaatatggaatttgctatagggatttgagcttctacatttgcgggaaggagcgagttgaacacttaggaacagctgttgctgccgtgtctggtggggggcctgagagtggcaggacaagcagcctgccccagaagtggaagaaactgaaagtggagtcctgagagctgaatctgccgcaggcccgcgggccgcccgggaattaggaaagttagaggggatccacgcccacaaggtaagccagcagatggggacaattccccgggctgcgacagtccctaatgtcgggcacctacctttcaagcctacgagacgaca

SEQ ID NO: 91899 - DNA, 2605 bp, Homo sapiens
attttttatgaatatttaaaattgaaaaagtttatttatctttgaatatatcacaagtatactcaactggcaatattttttttaattaggtaaaatgtacaaggtgtatcttcccacaaattaatgaaactgattttgaacaaacaaaattgacacacagatacattttctaagtgatgcacttttccaatgatgtcagcattactcaaaacattttttagaatataaacatataattgattttataattgctgtcagaaacaaaggcacattcttttactgtcccagaacattcaagatgctttcaatttattacaagtaccaaaagcagccacaactcaaatggctcaagcagttaaaggaattattctttcccataaaagcggtcctgaggtagggctacagtggctgaacttctgctatgataagtattcaggggtttcccaggacacagcatcaatgctaaaactggcaaaatcccaatggactgatcccttcaatggatgacaggaccctctatggctgaaagactctaaagttcttagttcttagctgtgacaggacagagaaccgacatgtcccacctgcagccacacccatccccttattattactagatcttatcaaaagctgacttgaagaggaaaaaaggccaaaagacttcttttcttcacctaaccgccgatgccctccttttggttttatggttccaacctgacagctactctgggctacaaagagccccttcttgacagatgactgccagctgcaggctagatcagactggtctctggagattgcacagatcgtgaacttgtgccctatgtttcacctttttgcatttacagcctaattataatacatttaaatgttaaatcttcaccccagagtgaacacaggtcatccgcttttggatattcttcatatgtaagcccagtgcgtgtctctaacgagtttcctccatgaattttcataggcttctcctgtatgctacagaatacgtatatcctacctctccacctagcataaatacctaccttttctccttcaaagtatgctttatggcctcaggtagaggcctgcttcctgcctgcaagttgtaacctcttagaaatagttatattttgtttattttgattcttttcagtcgacacatgcaaacaggaacgagttggctacttgagggttggttccttgtgcatctcagtgagtcttgaaaaaccccagatccgtccttccttcctgccgcatgtcatcctaaggccagtgtctgtcagggaggcaaggcagcagcagtacttttgggaaacatccagaataacattaaaaagcccctttttccccacacgtgtcttttatccagagggtctgttttccacaagttcttcagtgatttctccccagtctcattggctgggattggctttcacgcctcttaacaggattgaccatggttcatcaagggtcaacttgaaagctgaaccctgccaactttccctgaatctcctgactatggtggaggagtgtggatcctggaactaaactgaggtgatagggaggaaaagagagaaatcaacagtaaacgctgcacatcctctgtctggtaaatgtgcatcactgattgtatccaatctagattcaaccagagagacggaagcattaagaatgacatagaatatggaatttgctatagggatttgagcttctacatttgcgggaaggagcgagttgaacacttaggaacagctgttgctgccgtgtctggtggggggcctgagagtggcaggacaagcagcctgccccagaagtggaagaaactgaaagtggagtcctgagagctgaatctgccgcaggcccgcgggccgcccgggaattaggaaagttagaggggatccacgcccacaagtgctatggactctgatcgcccaaccagagcaaacccagaaggacaactctccaagcctttcaatcactcccactaacccgtattgtggacacactattgtgaggcctactaaggatgtactgctgatgaccttttgaaggccagtggacctgctctgcagacccaggctcctctcccatggagcatcccaagtctgtccttatgggaagaagcaggagccctgtctggctgtaccccaagctgctttctctggaccaatgctgtcagcgatagagggaacccttccaccatcatgtgaagaagcctggtctagcctgctggaggatgagagatcacatggaatgaggccacaatcgttccagccaaagccccagtaatagaattaagatcatccaagaccatggcatcccgcctgagaagttcagatgagaagggccacctgaacaaccaacagaatcttaaaaagtaaaaaatgagtgttgccactatgcatctattagaatggcagaaatcgaagacactgacaacaaattatgtggtgctgtgtaggtgaaacttttaagaaatatttttgaagcatatgttattatttgcactgctattgtgtgtgtgtgtgtgtgtcttgaatatatgtagaatgtgtgttgtgtgagagccagagagaggaaactcaagagagtgttgtcttagactgtctcc

SEQ ID NO: 91900 - DNA, 2995 bp, Homo sapiens
attttttatgaatatttaaaattgaaaaagtttatttatctttgaatatatcacaagtatactcaactggcaatattttttttaattaggtaaaatgtacaaggtgtatcttcccacaaattaatgaaactgattttgaacaaacaaaattgacacacagatacattttctaagtgatgcacttttccaatgatgtcagcattactcaaaacattttttagaatataaacatataattgattttataattgctgtcagaaacaaaggcacattcttttactgtcccagaacattcaagatgctttcaatttattacaagtaccaaaagcagccacaactcaaatggctcaagcagttaaaggaattattctttcccataaaagcggtcctgaggtagggctacagtggctgaacttctgctatgataagtattcaggggtttcccaggacacagcatcaatgctaaaactggcaaaatcccaatggactgatcccttcaatggatgacaggaccctctatggctgaaagactctaaagttcttagttcttagctgtgacaggacagagaaccgacatgtcccacctgcagccacacccatccccttattattactagatcttatcaaaagctgacttgaagaggaaaaaaggccaaaagacttcttttcttcacctaaccgccgatgccctccttttggttttatggttccaacctgacagctactctgggctacaaagagccccttcttgacagatgactgccagctgcaggctagatcagactggtctctggagattgcacagatcgtgaacttgtgccctatgtttcacctttttgcatttacagcctaattataatacatttaaatgttaaatcttcaccccagagtgaacacaggtcatccgcttttggatattcttcatatgtaagcccagtgcgtgtctctaacgagtttcctccatgaattttcataggcttctcctgtatgctacagaatacgtatatcctacctctccacctagcataaatacctaccttttctccttcaaagtatgctttatggcctcaggtagaggcctgcttcctgcctgcaagttgtaacctcttagaaatagttatattttgtttattttgattcttttcagtcgacacatgcaaacaggaacgagttggctacttgagggttggttccttgtgcatctcagtgagtcttgaaaaaccccagatccgtccttccttcctgccgcatgtcatcctaaggccagtgtctgtcagggaggcaaggcagcagcagtacttttgggaaacatccagaataacattaaaaagcccctttttccccacacgtgtcttttatccagagggtctgttttccacaagttcttcagtgatttctccccagtctcattggctgggattggctttcacgcctcttaacaggattgaccatggttcatcaagggtcaacttgaaagctgaaccctgccaactttccctgaatctcctgactatggtggaggagtgtggatcctggaactaaactgaggtgatagggaggaaaagagagaaatcaacagtaaacgctgcacatcctctgtctggtaaatgtgcatcactgattgtatccaatctagattcaaccagagagacggaagcattaagaatgacatagaatatggaatttgctatagggatttgagcttctacatttgcgggaaggagcgagttgaacacttaggaacagctgttgctgccgtgtctggtggggggcctgagagtggcaggacaagcagcctgccccagaagtggaagaaactgaaagtggagtcctgagagctgaatctgccgcaggcccgcgggccgcccgggaattaggaaagttagaggggatccacgcccacaagtgctatggactctgatcgcccaaccagagcaaacccagaaggacaactctccaagcctttcaatcactcccactaacccgtattgtggacacactattgtgaggcctactaaggatgtactgctgatgaccttttgaagagtggctagtggttggcccatgtaggctgagctcagctggtccatccttcttggacccacagactccctggggcatgttcttctcatgatgatgactgcaacacagagggcaagacatcctacacaagcacatttcaagattttgctcgcatcatctctgctaaaattcctttatccaaagcaaggaacacaactggttcaaataagcacaggcctccaaatatccagatctaaaaatggagtgttcacctcagctccttatttatcactgcaagagattctggggctggcagctagtgacatgagctggaatcctcttcctgaaattgctgtcttcttggatgggctctccacatcttccaccacgaagtaaaaacaattcttgtgggtgccagtggacctgctctgcagacccaggctcctctcccatggagcatcccaagtctgtccttatgggaagaagcaggagccctgtctggctgtaccccaagctgctttctctggaccaatgctgtcagcgatagagggaacccttccaccatcatgtgaagaagcctggtctagcctgctggaggatgagagatcacatggaatgaggccacaatcgttccagccaaagccccagtaatagaattaagatcatccaagaccatggcatcccgcctgagaagttcagatgagaagggccacctgaacaaccaacagaatcttaaaaagtaaaaaatgagtgttgccactatgcatctattagaatggcagaaatcgaagacactgacaacaaattatgtggtgctgtgtaggtgaaacttttaagaaatatttttgaagcatatgttattatttgcactgctattgtgtgtgtgtgtgtgtgtcttgaatatatgtagaatgtgtgttgtgtgagagccagagagaggaaactcaagagagtgttgtcttagactgtctcc

SEQ ID NO: 91901 - DNA, 954 bp, Homo sapiens
agcgggtggttcccgcttagctaggttgacatggtacaaagccacattaccacgctaagtgtggctttgatttttagaaacgcctcatgctaagtctagggaatacagtggttgaatggggtgagcgctgacgtttagctattctggaggaacatgtcactttcacttattttctttcatgttttcccacccagtgctatggactctgatcgcccaaccagagcaaacccagaaggacaactctccaagcctttcaatcactcccactaacccgtattgtggacacactattgtgaggcctactaaggatgtactgctgatgaccttttgaaggccagtggacctgctctgcagacccaggctcctctcccatggagcatcccaagtctgtccttatgggaagaagcaggagccctgtctggctgtaccccaagctgctttctctggaccaatgctgtcagcgatagagcaaacaagccaaacagcagcttgaaaaatgctttctacttggacataccctcttgctacagggaacccttccaccatcatgtgaagaagcctggtctagcctgctggaggatgagagatcacatggaatgaggccacaatcgttccagccaaagccccagtaatagaattaagatcatccaagaccatggcatcccgcctgagaagttcagatgagaagggccacctgaacaaccaacagaatcttaaaaagtaaaaaatgagtgttgccactatgcatctattagaatggcagaaatcgaagacactgacaacaaattatgtggtgctgtgtaggtgaaacttttaagaaatatttttgaagcatatgttattatttgcactgctattgtgtgtgtgtgtgtgtgtcttgaatatatgtagaatgtgtgttgtgtgagagccagagagaggaaactcaagagagtgttgtcttagactgtctcc

SEQ ID NO: 91902 - DNA, 263 bp, Homo sapiens
tgatagggtgcaaaatgcttcctttctagaggttgaaattatagtaagcaagattatccatcattcatttggaagatgactggggtggaggcagcatgagttgtgttgctggggcagacatgacataaagggtagagtcagtacacatacttgcaaagatgtagttatgagacctaatagggacctctctcctgtcttcctgtcctgtcccatctctccttccttcccctcctgtcatctccacatgactcccctctaatctt

SEQ ID NO: 91903 - DNA, 407 bp, Homo sapiens
tcctacagcacattgaaagttcctgcttacttttagagagtaagaccagcaactgattttaccacaaactcaccccagaaaagtccatccccagttgccaaaccctggcccctgctcacatgcctgcacaatctccccgctttccctcagtccgtggtgacaggagcagctgagaggagtgtttccgtttactgctggaacagcctttaggtctccatgtttgatgtcttcttgtttacactacaaaatagcagtttggagacacaaattgagacacatgcagtactgacatatatagatatctctcagtctgggatctttgcattaaatccagttcatgaaagacttggtgaagttgggggagttcctaggccctgacatggatcagagagtagtcctgggaagca

SEQ ID NO: 91904 - DNA, 433 bp, Homo sapiens
gcatattttgaaagttggtgctaatatttgtgctttggattaggccaaccacgattcagttacgggctttgcaacttactcatgtaaatttggaaaaggtatctaactctctaaactgcatatttctcatctgtaaaatgctgataaaacttttctcataaccttattataaagatataatatattttaaatgcccaagcatacatacagcatgtaataattatgtagtaaatgtgagatgcaattaacgtcagaaaactaagcgtagaaaaatagaaagctgatatcattgtaaagtccattacaatgtctgtgttttgtgtgcctggaacacaatatacttcatttttctaggttcaaggaccttgtaatttttttttatttttctatcatctcactgatatctccattaaaacatcatttatttgtttct

SEQ ID NO: 91905 - DNA, 167 bp, Homo sapiens
ataaagaaaagaggtttaattgcctcatggttccacaggctgtacaggaagcatagtgctggcctctactcagcttctgaggaggcctcagggagttttcacttgatgaaagcaggagcaagagagagtggggagggaggtgctgtgtacttttaaacaatcagatc

SEQ ID NO: 91906 - DNA, 1039 bp, Homo sapiens
  misc_feature (1036)..(1037): n is a, c, g, or t
  misc_feature (1039)..(1039): n is a, c, g, or t
ggggattatccacacagtgcaataccattcagtaattaaaaagaaatggaatactgatacatgctgcaacatggatgaacctggaagacattgtgctaaatgacagaagccagacacagaaagccatacataatacaattctatttctatgaagggtccaaaataggcaaatccatagatacagaaaggagagtagtggttctccagggtagtggaaaagggggtagtgaccgctattgggtatgaggtttctttttggggtaatgaaaatgttctaaaattgattgtgctgatggctgcaaaactctgtgaatatataaaaaaaattaattgtatattttaagtgggtgaattacatggtacataaattttaccccaatgaagttattttaaaaaatgaaacaaagtgtgaatgcagggatggctaaataaactgggagtgacgtcagcccctgatacacacattcttggtctacagcataagggctgtttcacgagagacactatcactggggttatgaacaagacagaagaaggcaaagaaaacaggagcccatctctagcaaaagagggccaaaacccaacttctcctgttagaacagcagggggtttcctggacagagaccctaaaaatatccaagtacatatcttaacacacactagactatatccctgacatagaaaggataacttctagaatcctgctaaaaatttagaagtgaagaaaagtttacacccttatcaagcaatccttagctctaggctgatattattaacacccctgtgtcccaaggccaggcatggttgccacgtaattggctgagctcattcaataattaggtcctcccttagccatagtcccaacttcagtggggaatggagcagcactaaaaggtcttgctcggctgggcacagtggctcacgcctgtaatcccagcactttgggaggccgagaccggcggatcacgaggtcaggagatcgagaccatcctggctaacatggtgaaaccccgtctccactaaaaatacaaaaaannan

SEQ ID NO: 91907 - DNA, 227 bp, Homo sapiens
tgcacctttaagttgggggagtttgaagacgttgccaagacacgtgctgcagcatttgatcttttctgccgcactggcttctgcaattaacatgctttcaccagtgaaactcaggttgcggggagagcattcttccaggttcatgcctgttgtcatggagtaattataattcatgtctccgttcacagtgtcctggtttgtagaataaaatatctggtccacccacc

SEQ ID NO: 91908 - DNA, 773 bp, Homo sapiens
aggaggggctagatcacacagcacctaaacatgttcggaatgtagattttatcccacaggcaacaaagaaacattcagagagtttgagcaaggatgtgacatgatgatgttagaattatttattatttatttgagacagggtctctgtcacccaggctggatgcagtggtgtgatcacagatcactgcagcctcaacctcctgggttcaaacaatcctcccacctcagtctcccgagtaattgggaccacaggcacaggccaccaaacccagctaattttaatttttccttctttctttctttcttttttttttttttgtagacagggtctcactatgttgcccaggctggtgtcgaactcctgggctcaggcagtcctcccacctcagcctccccaagtgttgagattacaggtgtgagccaccatgcccggccatgataggaattttttaaagaccactcagactgctgagaggtgaagagattagaaaggagtagaggtagatgagggcaggtcagtgaggggctgctggagtattccaagcaaaaagatggttgtttgcaccaaactagaacagtggcagagaagcttcagagaaaagaaccatccaagagtcgtttataagataaaaatcagcagtatttggtgcaggactagataagggcgaaaggagggaggtcgagcttgcattcgtagtgaggagaaatgtcaattacctctggcagaaagcacaggctgaacaaactctgcagctcacgtcgagcactgcact

SEQ ID NO: 91909 - DNA, 468 bp, Homo sapiens
gcctgtttgttttttcagattatagcatacagttgttgaggggtggactgtatcatctttatcttgtaattccagtgcttgtcctagtaccttagcacatggttgctgaatacatgaatgaagagtgagaaaccagaagctctgatacttaactgccatgataatgaattcagtgtgcaactatgggcaaattatatttaatagtaattgcatattgtacatatttttcattcttattaacactgataaacttttcaacatatactgactttctcttagttaactgtgaaatcatttaggataaaggaatataattctttttcattgtaacttctggaatttaaatctggaatcctctatagcaggggtccccaacccccgggtcacaggacagggtccctggacctgtttaggggaccaggggtgcacagcaggaggtgagtggcaggcaagcgagtgaagcttcat

SEQ ID NO: 91910 - DNA, 455 bp, Homo sapiens
agagagcaagctgacctcatgataaacactgcatgtgctgcaagcctcgtttattttcgtttctcccccctcttcttccccgatgaatttcatacagtttatagggacagtttcaaaataacagattaacaggagggaaaaacagtttatttacatgtgcaatgtgcatacacatggaagaactcagtggtgggtaactcaaaggagtagttagttagaatttggggccaatatgctatctaactcattctacaaagccagtctcaccctgataccaaagccaggaaaggacacaacaaaaaaagaaaactgcagaccagtatccctgatgaacatagatgcaaaagtcctcaacaaagtactagcaaaaccaaattgaacagcatatcaaaaagataattcagcacaatcgagtgggcttcatcccagtgaggcaaggatggctcagcatacac

SEQ ID NO: 91911 - DNA, 298 bp, Homo sapiens
tggcagcacacagatcagagggtgggctcctgtgggacagggtcacgcccacgggtggctgtgctcagttcttgattatcctccacctaccagctgcgtgaccgacattggtgtcatcaaaactcttcatttgggcataagagtggtgtttctcggccaggcgcagtggcttacgtctgtaatcccagcactttgggaggctgaggcaggtggatcacttgaggtcaggagttcaagaccagcctggccaacatggtgaaaccccgtctctactaaaaatacaaaaaaatagctgggc

SEQ ID NO: 91912 - DNA, 409 bp, Homo sapiens
cgcaacatgcttttaaataaccagatcgcatgagaactcactcactatcacaagaacagcaagggggaaatccacccccatgattcagtcacctcccaccagacccctccttcaacactagagattaaaatttgacatgagatttgggcagggacacaaatccaaaccatatcaactgtgacacaacttgctttcaccttatagctgaggaaatggggcataaaccacattcgttcattcacttcatacttagtgagggcctgtcatcactaccccatcttacctgatgaaatgattatcctgtgtccagaaataaatgtggaggtgaagtcatcagattaaaatattttgagaaaataggtacagatggttgagcatttctgtaacactttctcaaacttctttcatc

SEQ ID NO: 91913 - DNA, 174 bp, Homo sapiens
atcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaa

SEQ ID NO: 91914 - DNA, 102 bp, Homo sapiens
tgggtggaaccccatggtggtgtgacccctgccccttggatgcttatggcccagcaggggagtcgcgtgtgaatccagacaaacagaaacacccactgcagg

SEQ ID NO: 91915 - DNA, 415 bp, Homo sapiens
gtgtagctctagctgctggatttgaaacctacttccctgtggtagaaaactcttgaccatgatcaaagggctggtatctggtaaaggagacacctgggaagaactgtttttcgaaggtgagtcagaaagcttggctcatggctggggcaggggctcacatctgtaatgccagcactttgggaggctgaggtgggcggatcacgaggtcagattgagaccatcctggctacagcaaaaccccatctctactaaaaatacaaaaaattagtcgggcgtggtggcggttgactatagtcccagctacttgggaggctgaggcaggagaatggcacgaacctgggaggcggaggttgcagtgagccgagattatgccactgcactccagcctgggtgacagagcgagactccatctcaa

SEQ ID NO: 91916 - DNA, 484 bp, Homo sapiens
tgtcgcccaggctggagtgcagtggcgcaatctcggctcactgcaaactccgcctcctgggttcacgccattctcctgcctcagcctcccaagtagctgggactacaggcatgggccaccgcacccggctaatttttgtatttttaatagagatggagtttcgcagtgttggccaggctggtctcgaacttctggcctcaagtgatccacccacctccacctcccaaagtgctgggattacaggtcaccgcgcccggcccgagtctggacatgtacaggtttcttgctaggcatgaatgcagtaaatctaagatgcatgtagagagccagggttttcggcttggttgaagtagagtgagtctagaaggacacatagaagatgagggtggagaggtaggacgtggctgtgatgtggaatactgtgatacctgttccttttggggggcttttggctaaaatcatggtcatagttaggatgattaat

SEQ ID NO: 91917 - DNA, 412 bp, Homo sapiens
ttggcaataaatattatgggatggaaaagacctcttatggtctaaagaaaagcttcacaggctattaaaaatactatgattaaaacgcatactggtcctggatggcaaatttacttcccaacttgtgaaactaaagtaggtggctcatgttccaccaaatataaacagcccatttaatactcgttaaaaaatattaaactataatactttacacaatgctataaacgagaaaaacaccctacagaagttgtttttcaacttttgacactcagcttcacaggattattttacaggaatacacatgtgtcgagctgaatcaacacgctattttgtattcaatggaatattttctactttttaaaaaattcggatcaccacccactaaagtgacttcatgaccctataactcagg

SEQ ID NO: 91918 - DNA, 326 bp, Homo sapiens
gaaaaacaaggaaaataggcaacaacctgcaatggacacttttctctacagaaccttttcaaccctgaattgaattgtttcctattcattttttaataaaaagttactttgcaagatataaggaaatactgtcccaaagattttcactagtcattcaatccattaataggatttgaaaaggcatcattacacagggttgaaaatactctggaatgagactgctttacagtcagaatgcctgagttttgaggcactgttacttctaaacatctctaagtttctattttctcatctaaaggagtaatattactttccttaaaaggttg

SEQ ID NO: 91919 - DNA, 263 bp, Homo sapiens
gggtccatccacattttaccctggaggacccagaagcccagtcactctctacaaaaccccagccttgatacagacctctctgcgcgccccccaactgccccaaccctgattcatcccgctagggcccagtaagaacattcaccctccccaaggacctgcccccactcacgttccgcacatagactcccaggccgcacgctccggctctgaccccaatccctaaggaatttacacatttttcccttcccgaggccacgcccccc

SEQ ID NO: 91920 - DNA, 491 bp, Homo sapiens
tctgggtggaggacttaaaatttgtttttcaggcagcagatttaacccatggcaactgtaactcatcttgtgtgagtggcggtttatagtattgtatcctgtggcatcatacaaggggtgcaagttaaactctttaaagttaatcacgatttttgctcgtggccttctgggtttatccgtacgccgaagacaggcacctgtattacatgctaaggaaatgtgaataccaaaaattgatcctgaggaaagtcttgattaggtttttttggaatcgcctttgaaatgtaatttccctcaccttggcagtgcagaaagtttgtgatttttattgccgaaatagctttcaacattttgaaattgacttaagagaatgttggctgtgtatgtctgtatcttgcatttctattggctttgtgaacctaattgttttggatttagtctgatctttaaataaatgatttctttgtgttctctctaatggaagtctgtga

SEQ ID NO: 91921 - DNA, 447 bp, Homo sapiens
agaaaaatggcaggtatctggcaagatcaccctttgatgcaaggatccatcttcaaggaatttacctgctccatatagtcacaatatgcaaaatgactgatgtccatgtttgtattaacgagagactgggaaaaacccaaacttccatcagtctggaactggctaggacccatgtgccatccacgcaatgggaataccatgcagctcattaacaaacaaaaatccaggacactccacagacagatacgaaaatatctcagccgagcgcagtggctcatacctgtaatcccagcactttgggaggctgaggcaggtggatcactcgagatcaggagttccagagcagcctggccaatatgacaaaaccccatctctactgaaaatacaaaagttagctgggcatggtggcacaccactgcactccagcctgggtgacagagcaagact

SEQ ID NO: 91922 - DNA, 501 bp, Homo sapiens
agttccaggtacttccgggtcctgcgcgcttctcgcctgccctgcggaggtgcaaatggggaccctgagtggaagctgctgggcttgagccctgaccaccaatcccagctcccagaaggaagtttaacatgttttctggaacttgtttcttcagacttcaataaaaatactgggactcgaggcctgtgaattcccgtctcttctgatttggagggctatagatacagcattcccactcccatccgatcgatgcccctgaccctgctctggggaccaccaggaaggctggtcatgcccgctttgttcccaggatccctgtggccacaggttcctttccaggtgagcagctgctccatccgaaagatctcgtgggttgagaagtccttggagccccggggtggccagggacgcagataatagctggcattcctgctgagggtgatcaggccactagggtgcagaggggtaggagcgggtgtgagggagctctttccccatccc

SEQ ID NO: 91923 - DNA, 290 bp, Homo sapiens
gttgagactcagaagctctaagtgtttacccaagggcatactgctaattagaagcaggcctgagattataaagagtgctcgtctgcctcttccgttgatggtcagtttgatcatcataaagcttttgcccatttcctattaccagtttgtgcataacccgattaatggtgaatttaacttgatatatatatatgggtatctgtactgattgttataataataataaacaatttctaatatagatcttaccaggtatctggttttttttaaaggatttttatatataaatt

SEQ ID NO: 91924 - DNA, 557 bp, Homo sapiens
gattacaggcatgagctgctgcacccagccagtttccctgtttttaaatttttcttcatgttccatttcctggttttgtttattctaatttacaagagattttcctgagctgtatcccctggttcttctattgaattttttcatttctgctacaaaaatgttaatttccaagagtttttgtttgatccccgactttcctttttggtagcctcttgctcttatgttgtggattcaggatcttctcttatttcatatttctgaggattccagttgtaattttctgctgttttcttctgcttcctagattgtctctgttgtttattttggtctctggctttcaagttggagcttatcctcagacaataacagctaccattgagtatcagcccctattttaagtattttgcatgttttagctaatttaatccttacaacaaccccgggaggtagagccaggccctggtccctcccatcccaagcctggaaggttctcagttgagaatcagctttcttcttgctgatgtcaagggttgatgtcaggaaccctttatctgatg

SEQ ID NO: 91925 - DNA, 504 bp, Homo sapiens
aagccactgaacatcaggtacccattcagtattcaaatttccaactatctcataaacacctgtttttgtttgcttccgtgtttgaatctagatctaagtaaggtgtacacattgcagctagtttatcttgtctctttcaatttagtattctccctatacctttcccctcactggtaatttatttgaagaaacaaggttatttgttttgtacaattttctacagtctgggtttttatgattataggcccctggtatagcttaatttgttcttctatctgtactttttaaaaaaaataaattggtagttgtatctagacggggctcatttttgcttttggtgatgggcagggtggggtgcaggttagttcataagtggtattgtgttctccaataacacaggagacaacatatggttgcctctctaacatatacactttgaaaagctgatccatttatcacattaactgcaatgatcacctcaaagatgttttatcctaatttctg

SEQ ID NO: 91926 - DNA, 767 bp, Homo sapiens
gcctgggtgcaagtcactcaccttccacctgtggggccttgtgtccggcaagcgtagtggtcctgtggccccactcagagctagtggaggagaacagctgccgtttcctgcgtatttaggtggctaagcaggctgtcccagccacacggcctcaggcaagttcttaacctctgcctctgtttcctcatctgtacaacagggagagctggatattcacctggctgggactctcagaggcctcaggctatgaggggccggtagggggctttcctgctctcatttgttgtcatggcgatcctggcagatggggaactgcccccatttcacagaagacactggggccccaaagggttggagaatgggctaaggtcagagcaggaatgtggccagggcctggcccacctagctgacccctgctccacagtcaccgcaccacagaactggaaattactctgcagacaggcctgttccgtcagtgccccttctgttcccggctctcctgcccctatccgaaatccttcagcctcccaaggtgctgggattataggcatgagccgccacgcctggctgtcatctgtaatctttactcctgacctagtatgcctctccccactgccacctcactcctccagggtcttgaggtatccccacctgacctgggggcagctctgggctttggtgatgctcagaatgcccaggcactctgatcacagcctatcttaccctaggcctttccggattccgtcctctcgttcccttactcgctt

SEQ ID NO: 91927 - DNA, 486 bp, Homo sapiens
ggttgggaaaaaaacaaaaaaaccaaaaaaaaaaaaaattttaaaaccaccaccctccctgcactatcaccccattccccagaccttcttgcccccgccctcctggtctgtggacttccctctgctctgagcccagggagggggaagaagccagggggtagggtggccctgggaacctggctctgggtccccacttcctctcccagtgccgggctgggtggggtgtcaggtttatttatgtacctcttgcacactcatcaacctatgcaagtcccccaccccggccctccatgtttctgtgcctttgctcatcccctcaatctcccagggcttctccagtccccctcccactagctgcaggaagtgggatggatgggccacctcgtttggaatcagcagggtgtccctctcatgggaccctcccctctccccagcctgtcctgtcttgttcactctccatcagggtgagctgactgtgcctggcac

SEQ ID NO: 91928 - DNA, 308 bp, Homo sapiens
aggtaatatttagttaattgttcaagtacacaggttgacctaaaagcagaaaatataagagccttggtcttctgcctccctactgagcttggggttccatatcactttgtagagatgatcaataacaacaaatggcagaaagcagctgagacatttacattcaaatcacacactagaaaggaaaagaaaacaaaaaagagttccttttaaatggtttccaactccaaatttcctatgaagtttgacttaaaaagaaatatacttagcttcattctcggctctccaaaatcttggtcattcctaaaagc

SEQ ID NO: 91929 - DNA, 744 bp, Homo sapiens
  misc_feature (7)..(8): n is a, c, g, or t
cgaggtnntctagaggatcccttcgattggcgggcacttagggagacccgatctctacaaaaatatttaaaaattcgctggatgtgatggcacatgacgggttccagccattccagaggctgaagtagaagggacactggagtccaggaggtcaaggctgcagtgagccacagtcatgccactgcactccagcttgagtgacagagtgagaccatgtctcaaaaacataaagaaaggcagcttcaactcatgcactgagccctgaggttactgggaacggcaggtgcaaatatctcatgaggagatagaaagttggcataatttggatgagaaaggctactatggctgcaatatggtgagggaggaggttggagcttcagaagcaggtggaggacagatgtgcatgatttagagaaccaagggaaggagttgggtttttatctgaaatctgatgagaaattatgtttgcaattgatttctcatcagattttactaaaatacagagaatcagtaggaagggtactagctgtactctgatagatttctaagtactgcaaatggtgctaagtgctttgtagccgttctcttatttaatccttagaacaatcctgtgaagaaccttctaaatctgatggtatttatggctgtaagttgcccgctgtcgattggcgggcactcttagatgtagtgcgacagagcagtctacgctcgccgtacatctacatgagcgcccagagtctggac

SEQ ID NO: 91930 - DNA, 928 bp, Homo sapiens
tttttttctttttaagtagagatgaggtctcactatgttgcccaggttggtttcaaactcctgagctcaagtgatcctccagcctcccgaagtgctgggattacaggtgtgagccaccatgcctaacctcacatttgttaaggaatttagaaggcaactttgctaggcacggtgactcacacttgtgatcccatcactgagaaactgaggcaggagtatcacttgagtccacgagttcgagaccagcctgggcaacatggggagacccgatctctacaaaaatatttaaaaattcgctggatgtgatggcacatgacgggttccagccattccagaggctgaagtagaagggacactggagtccaggaggtcaaggctgcagtgagccacagtcatgccactgcactccagcttgagtgacagagtgagaccatgtctcaaaaacataaagaaaggcagcttcaactcatgcactgagccctgaggttactgggaacggcaggtgcaaatatctcatgaggagatagaaagttggcataatttggatgagaaaggctactatggctgcaatatggtgagggaggaggttggagcttcagaagcaggtggaggacagatgtgcatgatttagagaaccaagggaaggagttgggtttttatctgaaatctgatgagaaattatgtttgcaattgatttctcatcagattttactaaaatacagagaatcagtaggaagggtactagctgtactctgatagatttctaagtactgcaaatggtgctaagtgctttgtagccgttctcttatttaatccttagaacaatcctgtgaagaaccttctaaatctgatggtatttatggctgtaagttgctggcaatgttttaatctctttgtataaataaagtcattttagccttacaactac

SEQ ID NO: 91931 - DNA, 341 bp, Homo sapiens
agtgtagtggtgcgatcttggctcactgcaacctccgcctcctgggttccagtgattctcctgcctaagcctcccaagtagctgggattacaggtgcccaccagaacgcccagctcatttttgtgcttctagaagagacagggtttcaccatgttggccaggctggtctccaactcctggcctcaagtgatctgcctgcctggcctcccaaagtgctgggattacaggtgtgagccactgcaccctgcctcagtacctccattcttcccacacaccctcctcacgtgctccttcctgacttctgggcccttccttccttcttttttttttttttttttttt

SEQ ID NO: 91932 - DNA, 446 bp, Homo sapiens
tttttaaaaaggcagttatgcttttagaatgtgaaatcccttggggagccaccgtaggttggatggtaagtagaatatcaattttgtgtgttattgctgaaatgcctaggacagttctgttaatttagattttcttttcagggtcatttgctgttaacttgtaatatccttgaagaaaaaaagatttccccaaaatatcaatttctacacagtttctctgtaaattttctaaactttgaaattaaaagaaaaagtaatgcacttttaattctggttaaatcctttgaacatatactactagataaatgtgtttgttttgttataggtaaaaagaagcctttcttgttaactgccaagatttgtagtcattttcatttctaacatagcagcaagatggggaactcctgctattttggtttctacacaattgcataagtctcttcttg

SEQ ID NO: 91933 - DNA, 373 bp, Homo sapiens
ggatttgactattttcattaagccaacaatatttcataagcatacgaaagctaagattattctgttttcggatgggctttctagttttataacccttatggtcaatcttatagtattctgcaggaatacataaaaccacatgaccaataaatgcaaaaaaatgcaaacaattcttaggacatttttaatatcattttaccaataactttaaagccaattatttattaaagatttttcttaagtcacgtgaacttggaaaaagcatttgactagtctttttttaaagtatctgatttaagcacttttattttttaagccaattaattagagctcttttatgtatttttagtagtgaaacgttgtgtacacaaca

SEQ ID NO: 91934 - DNA, 565 bp, Homo sapiens
gaaatacagtggcctttcacaataaaagactagattttaagagtctcttaattatttggtgagagacacaggacagtacaatctgtgaatttctattcttttgaactatggagattttatcatgactggacaatgagaagaaatgttatagctgtagcttgatggttttgcttttataaaattcttctggtattgaagagaaaaagattattaatgggtaaagtaagaaaaattaactccattcctactgggtgacttttattatcagatagcaatctgataactgattattattagtttggtgacaataattatttttggatgcttggttgctaataatttgcctgatgcctagaaaattctgatttggggtctgtattctagtgggcatatagcccaaattagcaatcagattcttctactaaaattatctgatcaagctttcagataattcatgcatttacatagaatacatatcagtggtttaaacagaatttcacagacgctttcccattgaagctgattgtttggcaaaatggtgagtcatgctttactggccaactca

SEQ ID NO: 91935 - DNA, 295 bp, Homo sapiens
cctaaacttaagggttaaattataaaattcttagagaaaatatagaggaaaacctttatgacattgaatttggcacggaattacttggatttgtcaccaaaaacacaggtaaaaaagaaaaaatagataaactggtctccatcaaaatttaaaacttttgggagagatttgttaaaggatacaaaattacagctagataggaggaataagttctataccattgtaagatgactataattaacgataatatatagtttcaaatagctagaagatactgacggttcccaacacaaag

SEQ ID NO: 91936 - DNA, 1778 bp, Homo sapiens
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcccggcggcggggaggggaggcgggggcgcctccggcggcgagatgcagaggtgaccctcggacccgctgccgttcgcgaaccctagcagaggactcagccaccgccgaggggagggtgaggcggccgggggcattaactgacctctgagtacagcaataaaataacctggggatcttttaaattg

SEQ ID NO: 91937 - DNA, 1044 bp, Homo sapiens
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggaggttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcggggccaaggtgtctttcgtgccccgggcggttgacgctgtttgagccca

SEQ ID NO: 91938 - DNA, 1716 bp, Homo sapiens
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcggggaggggaggcgggggcgcctccggcggcgagatgcagaggtgaccctcggacccgctgccgttcgcgaaccctagcagaggactcagccaccgccgaggggagggtgaggcggccgggggcattaactgacctctgagtacagcaataaaataacctggggatcttttaaattg

SEQ ID NO: 91939 - DNA, 2017 bp, Homo sapiens
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggacagaagcttttcctcaaaggtgcaaaaggagcaactgtgttgaacaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgaggcccttccgctcccgccccattcctgtgtagcagcgggtccgcctcgcctgggtctcccagggctccttcccagtatctcctccgcacccctggggaccccagctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcccggcggcggggaggggaggcgggggcgcctccggcggcgagatgcagaggtgaccctcggacccgctgccgttcgcgaaccctagcagaggactcagccaccgccgaggggagggtgaggcggccgggggcattaactgacctctgagtacagcaataaaataacctggggatcttttaaattg

SEQ ID NO: 91940 - DNA, 504 bp, Homo sapiens
cagccgcccctctccgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcc

SEQ ID NO: 91941 - DNA, 729 bp, Homo sapiens
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggacagaagcttttcctcaaaggtgcaaaaggagcaactgtgttgaacaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccaggtaagaccccagcccaggccagaatctgggggaggcttggggagactgcaagggtggggaaaggggaaagggcagttgttgcaggtacccagggactgaaagtcattgctgagaaggcaatggaggagagggttggggggctctggagaaagcatttggggagcagggtctgatgggcacttggggca

SEQ ID NO: 91942 - DNA, 1968 bp, Homo sapiens
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgaggcccttccgctcccgccccattcctgtgtagcagcgggtccgcctcgcctgggtctcccagggctccttcccagtatctcctccgcacccctggggaccccagctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcccggcggcggggaggggaggcgggggcgcctccggcggcgagatgcagaggtgaccctcggacccgctgccgttcgcgaaccctagcagaggactcagccaccgccgaggggagggtgaggcggccgggggcattaactgacctctgagtacagcaataaaataacctggggatcttttaaattg

SEQ ID NO: 91943 - DNA, 1978 bp, Homo sapiens
gagggctgggaacccatgaaggggagtggaataatttgagcaacccaggaatgatgacctggaagagtgcagaaagtgaggtgcttcattttttctcgatgcctttgaaccagagaggtgtagattgatcggtggatatgaaggtgttggactgatgggggtgggggtcgttcttggcaccttggcttcttctttgagcacaggacagaagcttttcctcaaaggtgcaaaaggagcaactgtgttgaacaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgaggcccttccgctcccgccccattcctgtgtagcagcgggtccgcctcgcctgggtctcccagggctccttcccagtatctcctccgcacccctggggaccccagctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcccggcggcggggaggggaggcgggggcgcctccggcggcgagatgcagaggtgaccctcggacccgctgccgttcgcgaaccctagcagaggactcagccaccgccgaggggagggtgaggcggccgggggcattaactgacctctgagtacagcaataaaataacctggggatcttttaaattg

SEQ ID NO: 91944 - DNA, 409 bp, Homo sapiens
gaccctaatagttaggagtatcatcgcccctattcagcatgaagttacagaagatggaccttcatccttctgcaacccctaggattaagggtccccttgtaaaagggaaaggtggggaggtatgtgggaagcattcaaactagagcaactctagtttgaataagagctaagaaaaatatagctggatcaccaaccagtaattaagggctgcacagcctgcaactgccttgttccattagaaggccaccttctatgctagtaatgataccttctcttttacaaaaaaaaaagaggaggggcatgttgggaaaaagctgagtgttggaagggaaactgaggcagggcattcatgtctgacataatgtcctctggactgtgtctagacttgctggctccttgctactagccc

SEQ ID NO: 91945 - DNA, 679 bp, Homo sapiens
gctgtctgtagaatgaaatgacacattgccatcagacgcagtgaagcatgtcatacagtgagtgtctggtcacagcaggaagatggtgaatgtcagctaatgagtattcatcaccaatgaatagtaacagttttttttactaaggctatgtaatgtagcctcagaatcccactcagcatagccccctggcagcggtgcctctgagagctggcatgatggagagagcctggttggccttactggtgtggttggggcacttgggagaacgccttcctcacaaagctcatctggagggttttcggacttgtaggatagctttttcaggggccttgcctttggcagggcagggacgtgtactgctgcagtctagggtatgggataactttctaaaccagacccagaacttcatggccgcaggggccttttagccatgcggggctaggagctgacacagcgtcagcagcatgagggcctgtggtgctgggcggcagagcccagagggagcccctgctggtgtgactttagtgtaaaggctgggggataccagattcttacagaagacttaagacgggcacagtgatgtctgctctttgacccttgcagtatgaattagtaaaactgaaattattacatttcctttattaggattataaaagcaatgatgacttattgaagaaaa

SEQ ID NO: 91946 - DNA, 343 bp, Homo sapiens
ccttgtttttaagaccttatcttttcctatccctcttgtaaaaattcttttctcctcaagttacagctaaatctcagacttacttttaattgctttccttttttaattcccaagtttattttgtttaaaatatctggccatcaaaactttctgagagtttggaaagaaatataactcttttagaattagagaattgttaaaccttaaacatttttctcctttgatcctaaaagtaaaatgtcttcccactacttcgaatatggtcttctataaagattaaatgtgggtactgaatacatttgaggaaaagattttaaaagctaaaaaaaaaaaatcataatct

SEQ ID NO: 91947 - DNA, 124 bp, Homo sapiens
cgattgtgtctgtggataaggctcggatgcgcttctgtaaactggttagagagattgtaatagaacggaatgatggaataaatctgcttctggtcacagcacatgtccttctcaaataaggact

SEQ ID NO: 91948 - DNA, 597 bp, Homo sapiens
actagttctagatcgcgagcggcgcccttttttttttttaatgggggtattgggtgggacagacggggtcagggaggccccaccatggcttgtcgagggcacgggcacctgcatggcggcgctctccctgcctcccctgccgggctgcaagcctgaggtctgtgctgccggacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcagaaaaaaaaaag

SEQ ID NO: 91949 - DNA, 2338 bp, Homo sapiens
  misc_feature (1509)..(1509): n is a, c, g, or t
ggccccgaggcaccttccacaagggcagcgccaccaagcctgcgggctgccagagctcatcaaaggacaggtcggcagcatccacccccagcaaagcactcaagttcccagtgcacccaaggaaggcggtggggagcctggcacccggggagctggccctgtggcacagagaatgggatgaagcccgcacccccaaagccaaacccggccccagctcccagggcagtggaagccctcgccccggcaccaagacaggaggtggcagccagccccagccagccagcgggcagctccagagcgagacagcaccaccccagacaagcccagcttccccagccggagccctgcaccagagaggctccccgctcgagcccaagccaagagctgcaccaaggggccaagggaagctggtgagcaggggccccacgggagcctaggtcccaaggagaagggagagagcagtacgaagaggaaaaagggccaggtcccagggccagccaggagtgaaagtgtggggagcttcgggagagccccctcagcccctgacaagcccccccggacccctcggaagcaggcaactcccagccgcgtgctcccgaccaagcccaagcccaacagccagaacaaacccaggccgccaccatcagagcagcggaaggcagagccgggccacacacagaggaaggacagactgggcaaggccttcccccaggggagacccctgctcaggccccccaagaggggcacagctgtccacggtgctgaacctgccgagccgcacacccaccggacggccgaggcccagagtgacctcctcagccagctcttcgggcagagactaactggcttcaaaatccctttaaagaaagatgcttctgagtaatttctaggagcaagagcctgggaccggagctgggcgttcctgtctcggcctgcctccttggccagctccggctccctgagatggtccactctgtggccacttgacttcttgtgcaactgctcaggccttgatgtcagagctgaggtggtgatgctttgaacagggcccaggtgggcagcattccctttcttgctggaaggctgggggtgaaagacggggccactgcagcccttttgagaccacacagctgttttcttggtaccaagtacttgaagagacagcagcccatcccctcagcccacacccctgcgccctgtgggcaccgacaccacagaagccaatgtttggagatttgcacaacctcccgttcccccacatggagaagggaagtaagttgaggcagccgtgggatggtggtaggttccctcttagtcttgctgctgttgctggaattccaaagtgaccttagaaaccacgtgggggaaggcagtgctcactacttagaagggttgcttctgagccgcctggtcccccaagagcacaacaggcctcctccctctgaccacagggtcatgcctcctccctctgaccacagggtcatgcctcctccctctgaccacagggtnatgccagcctccatttgcgctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccacctatttgcaatgttactctgaagtttctggtgctatttttgtgttgtaatgtgaacacaggcttccttgatttttttttttaatgggggtattgggtgggacagacggggtcagggaggccccaccatggcttgtcgagggcacgggcacctgcatggcggcgctctccctgcctcccctgccgggctgcaagcctgaggtctgtgctgccggacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcagaaaaaaaaaag

SEQ ID NO: 91950 - DNA, 2311 bp, Homo sapiens
ggccccgaggcaccttccacaagggcagcgccaccaagcctgcgggctgccagagctcatcaaaggacaggtcggcagcatccacccccagcaaagcactcaagttcccagtgcacccaaggaaggcggtggggagcctggcacccggggagctggccctgtggcacagagaatgggatgaagcccgcacccccaaagccaaacccggccccagctcccagggcagtggaagccctcgccccggcaccaagacaggaggtggcagccagccccagccagccagcgggcagctccagagcgagacagcaccaccccagacaagcccagcttccccagccggagccctgcaccagagaggctccccgctcgagcccaagccaagagctgcaccaaggggccaagggaagctggtgagcaggggccccacgggagcctaggtcccaaggagaagggagagagcagtacgaagaggaaaaagggccaggtcccagggccagccaggagtgaaagtgtggggagcttcgggagagccccctcagcccctgacaagcccccccggacccctcggaagcaggcaactcccagccgcgtgctcccgaccaagcccaagcccaacagccagaacaaacccaggccgccaccatcagagcagcggaaggcagagccgggccacacacagaggaaggacagactgggcaaggccttcccccaggggagacccctgctcaggccccccaagaggggcacagctgtccacggtgctgaacctgccgagccgcacacccaccggacggccgaggcccagagtgacctcctcagccagctcttcgggcagagactaactggcttcaaaatccctttaaagaaagatgcttctgagtaatttctaggagcaagagcctgggaccggagctgggcgttcctgtctcggcctgcctccttggccagctccggctccctgagatggtccactctgtggccacttgacttcttgtgcaactgctcaggccttgatgtcagagctgaggtggtgatgctttgaacagggcccaggtgggcagcattccctttcttgctggaaggctgggggtgaaagacggggccactgcagcccttttgagaccacacagctgttttcttggtaccaagtacttgaagagacagcagcccatcccctcagcccacacccctgcgccctgtgggcaccgacaccacagaagccaatgtttggagatttgcacaacctcccgttcccccacatggagaagggaagtaagttgaggcagccgtgggatggtggtaggttccctcttagtcttgctgctgttgctggaattccaaagtgaccttagaaaccacgtgggggaaggcagtgctcactacttagaagggttgcttctgagccgcctggtcccccaagagcacaacaggcctcctccctctgaccacagggtcatgcctcctccctctgaccacagggtcatgccagcctccatttgcgctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccacctatttgcaatgttactctgaagtttctggtgctatttttgtgttgtaatgtgaacacaggcttccttgatttttttttttaatgggggtattgggtgggacagacggggtcagggaggccccaccatggcttgtcgagggcacgggcacctgcatggcggcgctctccctgcctcccctgccgggctgcaagcctgaggtctgtgctgccggacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcagaaaaaaaaaag

SEQ ID NO: 91951 - DNA, 404 bp, Homo sapiens
gcagcgtggagaggagctctgctgtatcactgctgcgcctgctcccctgagccccacctgttcctgctctgctcagcagctcacctaaatgctcccaagcaggtgctcggcacacacttcagcaagcagcatgatgaaagaatgacgagtaagtcactggttctctattcatctttacaccgcctcatacacactgacctcattggtcttacctgattttcctcaatttgattctcagtttatcctcgcttatctgtgatgtttttggagcagactcccatttttatatctctgttccttgacactctaccctgcttctagaatgcccttcatctctattttaatcttttttttgaaaccaagtctcactctgttgcccggctggagtgcagtggtgcgatctt

SEQ ID NO: 91952 - DNA, 311 bp, Homo sapiens
acttatgtttaccagtttaattgtaaaggatatcacaatagatacagatgaagaaatgcatagggcaaggtatggggaagggacacggagcttccatgcccttcctgggcaccctgccctcctggaacctccacatgctccgctatccagaagctccccaaactctgtcttcttgggccttctatgaaggcttcattggataggcacgtttgacgaccatgtagaaatgaaattaaacaaaaatggtttggccgggcacagtggctcacacctgtaatcccagcactttgggaggccaaggcaggtggatc

SEQ ID NO: 91953 - DNA, 398 bp, Homo sapiens
tggcaaaaacagtatttgatgaagcaattactgaattggatacactgaatgaagagtcttataaagacagcactctgatcatgcaattacttgggacagtgttactctgtggacatcggaaaaccaggaagatgaaggagatgctggggagggagagaagtaatgtttcttgtgctttgtaatctgttcaatgtcactctgtaccctccacgtatatcccttgtgtggtaaaaaataattgtatgttgactttggatttttcacagcctcagcctagcaaaaatggttcatgggataaacagctggtgtttgtattctaaaactcagattggtcacataaatgccacggcattctgaagttttgattttgattaacattgacaggattactgtgtgtt

SEQ ID NO: 91954 - DNA, 1237 bp, Homo sapiens
gcagccagatctgctgggacacctttcccaaggaagagcccgttgcactgggctttgaaggataagcaggagcttgttactcaggcagaggaagaaagagcatcccaggcggggggagcagcatatgcaaaggcacgaaggggccccaggagcctagggagtctggggaagtgtgagcactttggagagtggaggctggagcgctgtggagagtgggggctggtggccgggaatgaagctgcagctggctgggccacatggtaaaggctgacaactggacccagaggccaactagcctatgatcagcatttcccaaaatctgtttcccgactcatggttctgtgagatgtgacaagggctcctttttcattcctgagacgccggttttcatctgtgatgcggggacagctgcgctccttgctgcgaggcgtcaggacccaggtgatagtgaagggagggtggcgcccgcggttcccggcggccactgatgcctgtctctctgtcgtgtgtacgtgcgtgtgtgctccacgcctggcttctcaggctttcaaatgtgtgtcagcagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaa

SEQ ID NO: 91955 - DNA, 908 bp, Homo sapiens
agcggggcgggaccgcgggaggcgcgcggctgcccgagcgccggccgggccatgacccccgctgctctgtcttgcaggctcgtcgccgcggccccccgagcccgaccgccgccgccaccaccaccagcgcccgggcgggcctcgcgcgcctcgggcgcggctccgcagtgagcccaccaagaaggaagcggcctgcagaggtgccgacatggggcttaagatgtcctgcctgaaagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaa

SEQ ID NO: 91956 - DNA, 1408 bp, Homo sapiens
gcagccagatctgctgggacacctttcccaaggaagagcccgttgcactgggctttgaaggataagcaggagcttgttactcaggcagaggaagaaagagcatcccaggcggggggagcagcatatgcaaaggcacgaaggggccccaggagcctagggagtctggggaagtgtgagcactttggagagtggaggctggagcgctgtggagagtgggggctggtggccgggaatgaagctgcagctggctgggccacatggtaaaggctgacaactggacccagaggccaactagcctatgatcagcatttcccaaaatctgtttcccgactcatggttctgtgagatgtgacaagggctcctttttcattcctgagacgccggttttcatctgtgatgcggggacagctgcgctccttgctgcgaggcgtcaggacccaggtgatagtgaagggagggtggcgcccgcggttcccggcggccactgatgcctgtctctctgtcgtgtgtacgtgcgtgtgtgctccacgcctggcttctcaggctttcaaatgtgtgtcagcagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaaaaaaaaaaaaaggaaaaaaaaaataaaaaaacaaggggggacgaaaaagaaagaaggaaaagaggagaaaaaaagaaaaagggggtgaaaaggagggggggtgaaaaagggggtggacaagggggggaaataaggtgagagcggaaggggaaaaaagggaaaagggagaag

SEQ ID NO: 91957 - DNA, 972 bp, Homo sapiens
agcggggcgggaccgcgggaggcgcgcggctgcccgagcgccggccgggccatgacccccgctgctctgtcttgcaggctcgtcgccgcggccccccgagcccgaccgccgccgccaccaccaccagcgcccgggcgggcctcgcgcgcctcgggcgcggctccgcagtgagcccaccaagaaggaagcggcctgcagaggtgccgacatggggcttaagatgtcctgcctgaaagacgccggttttcatctgtgatgcggggacagctgcgctccttgctgcgaggcgtcaggacccagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaa

SEQ ID NO: 91958 - DNA, 995 bp, Homo sapiens
agcggggcgggaccgcgggaggcgcgcggctgcccgagcgccggccgggccatgacccccgctgctctgtcttgcaggctcgtcgccgcggccccccgagcccgaccgccgccgccaccacccaccgagtcggcgccgtggtcgggcccttcgacagccgccgttcgggggcgcggggcatcccggccaaggtgttgaggtccccacccaaaccccaaaaaaagggggccaacaaaaacggggggggaaaaaaggggccgggggccccttgggccaaggaggggtggcccgagatgggggcttaagatgtcctgcctggaaagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaa

SEQ ID NO: 91959 - DNA, 189 bp, Homo sapiens
catgtctgagtcagcctctccgtatcccctttatctcctggcagaatctctggttcctggctcaggcacatccatgtttttgatttttgatttttggttttggaattatcttttgacttaagaagtcacaaaaataatacagagttctccagtacccttcactcaccttcccttatgttaatgccttac

SEQ ID NO: 91960 - DNA, 198 bp, Homo sapiens
ctttctattcccttttcttcatgtcgtttatgatcaagatttctacaatttattattcttccttgaagactgatcaacttgagatagtactgggagcattcaaaataatgcccttatcctgtcatctcctgtgatctcttccttctgtcaaattacctgtttcatacagatctcctgaattaaagggtggagtctgtc

SEQ ID NO: 91961 - DNA, 296 bp, Homo sapiens
ctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtag

SEQ ID NO: 91962 - DNA, 364 bp, Homo sapiens
ccgaagacagcttatttttcataagcaacagtctggaaatttaattgatatgccattcctgccccccagtccaaacccctgcccagtctatcctttttacctactttgactttgattcttttagttcttcctattttacaatcaccagccattccagaaaaacatctgctaaaaagatccgttccctgtagtgggaattaagtacatattttaacttcagacaattttacttaatgttttctacattgcatggagcagaggattaatgcagacgtccctgaaaagctcctatgcaaccttaagctgtgtcttcaatcattcaaactgttcaagggctggaatttgaaagagggtgaggaagtac

SEQ ID NO: 91963 - DNA, 387 bp, Homo sapiens
gaagagggaggaaatacgggaggaagagggaatggcgaggaagagagagaggaaataaaaagaaccaaaatggaagaaagacaaaagacaaaaaagtggttagagaaagaatagaaacaagacatttaacttcaaagaggaaggggcctatcactttgaattagaataaaagtaaataagctggtgatgtggtccctcactcacagctgtcacctgctcagtatagtttcaaattcattagaattcagaacatgaagcagctgaaacttctaagggagttcaacttgaggctaattcaatgagatagcactccagacacccagaggcattagaggttctcatcacaagacacttggttgacagtactctggccagagccctccttgg

SEQ ID NO: 91964 - DNA, 494 bp, Homo sapiens
agttctattattattgcatattcattgtctcagtttgtatattgtatctctcaattccatttatataacattcttgcaaagacaaaattataggattggagaacagattagtagttgccaaggcttaaggagggggtttaagtgagaggaaagtagatgtaaaagggcagcatagggatccttgtggggatggaaatgttctctgtctttattgtatcaatgtcaatatttggttgtgatagtatattatagttttgcaagaagttactattgagataagttgggaaaaggatacaagtgttctctgtgtattatttctttcaagtgcttatgaacccacaattatctcaaaggaaaaaatatttaattaaacaaaaaaattccaagagataggagactggttatcttccaaagaatatcagactcacaaccgaattctcgaaaacaataaaagccagaaaaaaattctttaagtaatagattcaaactgctga

SEQ ID NO: 91965 - DNA, 139 bp, Homo sapiens
gaaggtgctgttcccgcaagaggcacactctactgtcgtcgccagtgttcttcttccgcgaatccccatgtgagcgtattttttccagcggctgctaagccagatttagccaccagggggcaaaaaagcagcccttaag

SEQ ID NO: 91966 - DNA, 287 bp, Homo sapiens
gaccggaaggatctgtgggcatggagagggtgcagttggagtgtgaatctggggctcaggagagaaacctgggctggaaatacaaacgtggagttgtctgcatactcatgggccagaggtcagaaccgaggcaggtggctgggggagctggcctctggcccatgagtatgcatacaactcatctttattcatttgccatccctttttgtgtatttatctccctttggagcctcatgagatttatagtagaggaaggtatgaggactcttgggtttcttagtccagtg

SEQ ID NO: 91967 - DNA, 603 bp, Homo sapiens
gcttaagcttctaatggatcaacactctatgagtcagctcttatataagtatcaaaaaaatgcatctagactgggcactgtggcctgcaatcccagcactttgggagacttaggtgggaggatcccttaagcccaggagttggagaccagcccaggcaacatggtgaaaccctgtctctacaaaaaattggctaggtgtggtggctcacgcctgtactcccaaagtgctgggatgacaggtgtgagccaccgtgcctggacacccaggctgtttcagactcctggactcaagtgatccctccgcctccgcctatcaaagtgctgggattataggcatgagccacggcacccagcaaggcagcctctttcatgagccactaggttctggggggtctcagtcctggttaagccctttgatgagtggggcttgaggtcttactccatttactggtttgaacctggagaagccttttgtcttaaacagtttttgtttctagggacatggatgccccattgactcctggggagatcctggtctggtggggaggaggccctggagagccccccacctaactttggcctcatcctcttgtggtttctttc

SEQ ID NO: 91968 - DNA, 118 bp, Homo sapiens
cataaaacagggacctctgacgcttcacattatcaggtaagaaatgtttcttgcccagcagcccccagaggatgaacagctccctccacctgaaaggggaagagggcccaagctgcag

SEQ ID NO: 91969 - DNA, 686 bp, Homo sapiens
aaaagagggaggttgctacatgggtgtctgatggaagagggtgccaaccagagggaagagccagtgcagaggtcctgtggtgggagtgtgtctgatacgttggaggcaagtgtgtctgaggcagagtgagcgaggaggcagtggaaaaaaaggagggagcgaggtgacaggcagctcatgtaagggctcatagaccattaggccatgatcaaggttggctttaggcctcagtttacatctggcttcctaggacgggacaagcatcattgggctggaaggaaactcatccataaagggcttgtgtagcctcatggctaaaattcctgtctctgaagccagacagctgggtccataatccagctctgatctttctagattgggagaccctagccaagtcactcctctctgggccttggcttccccgtctctgaaatgggcctagtaaaaaccgtattcccaagggctgatctgacgaactggcaaaacaattcagggaagctaagggcattgaaaccttggtcggtgaacaaaaatgcatttctgggacaggtatagtggctcatgcccaacacactttgggaggctgagagggaggcggatcacttgagcctgggaggtggaggttgcagtgagccaatatcatgtcacttgcactgcagtctgggtgacagagtgagaccctgtca

SEQ ID NO: 91970 - DNA, 865 bp, Homo sapiens
ttcacagaatcatagttgtcccaatgtgatactttatgaaaacagtatatttcaggatattacaaccagactaaatccaactgaaagtcaaataaaggaagaaagacgctaggaatgaaataaattttggatcaatccagattcatcaccaactgatatgattgggatctgtgtcaccaccaaatctcatgttgaattgcaatccgtaaagttggaggtggggcctggtgagaggtgataggatcatgggggcagtttctgttgaatggtttaacaccatttcccttggtactgttgtcacgataataagctcttttgagatctggttgtttgaaagtgtgtagcacctcccccacccatgctccagcgatttgaatactggctccccctttgccctccaccatgactgcaagtttcctgaggcctccccaggagctgaggagatgctagcatcacgcttcctgtacaggctgcagaactgtgagccagttaaacctcatttgtttataaattacccagtctcaggtatttatttatagcaatgcaggaacgatctattacattatccattgtcataattgaaccagaactctcctatagctattgaggatcttaacatgttgtttcaaataaaaataaagacaccattctgaaccaactttacatttagaatatgccagtttctatattaatccaggaaactcagcatctaagtttcccctaaagcatctgttcctggggtgtacccacaaatttataaagttataaagcccaaagagatggcccacatgaattcacttcagcctgagtgatgactacctgattcctccagttattagcaaatttttctgtttgctctctcttg

SEQ ID NO: 91971 - DNA, 316 bp, Homo sapiens
taaaattttccacaatctccagggagactgttttcccctggcattttccaaatatatgggatgccggatctcaaatcctccaccctcataccacagcctgactcttcaagggcttgcagtgaaatctgtgtctgaacatttcacatgagaggaaagcagtgaataaccactagacattttcccgaaaaatcctttctgcctctcctccttttatctttcctagacacagtcaccttatcaggatgtctttgggatgcggttcctttctggaaacattacagggtgatgtgtcttcagtgcaccctcctatcttttc

SEQ ID NO: 91972 - DNA, 377 bp, Homo sapiens
gagattgtgccactgcactccagcttgaacaaaaagagtgagactatgtctcaaaaaaatgaagtcattaagtgtctatttgatgcttttagctaatcaaataaatatcactagttttgttgttgttttgagatggggtttcactttttcgcccaggctagagtacagtggtgcaatcctggctcactaaagcctcaagctcctgggctcaagtgatcctcccacctcagcttcacaagtatgcgggactacaggcttatgccaccatgccaggctaataatagttttgactttgatcaactgtattacccatttttaatgttaacttttctaatccattattagattttgtgggtttttttagagtaattccagtt

SEQ ID NO: 91973 - DNA, 1129 bp, Homo sapiens
taaatgagtagtgaattaattcattaaaaacatttattttatgtccgttatgtactagacactgttttaggtgtttgggttgtattactgagtcctgtatatgacagtaccaatttgtaatactgaaatattaacaaacttgttttatacattatggtataaaaatagtcttgcactgtttaaattatgctcaaaacatgagttccttgaggtcagagattgtcttactcatccttgtaggccagttacttaagcatagcacctgatgtttaataggtatgttcatgaaatgtttgaattactgaaactgttaaataacagaataattctgtaagatttttacatggaattactatctgtgttttgtaaaagatggaagaaaaacagtattaaaattatatatatagcattacagaactttttaatgaaaaagattacttttttaaaaatatcactgagttctaaattcttgctataaaggcaaaatatagtaaaattgtgaaatgtattcttaaattatttcccttctctagtataacctttcccgcatgaaacaggaagtctttcacgtgggtatttttttagtgcatggtattactacaattatgataagtgatcttagtatactttactaaatatagacgtgaatctttttctcaccagcaaggaatggacctgtaagactcagtcgtcactaaggatgctttccatgctttaactattttaaccaagaattttagaagaaagaattaggaagtagagttgaagtagccttgatctgaactcccatctctgcattcttgccaggcatagatgtcattcttgtgtacagatctatatttttttcatttgaatctgtgatgtatacagctcattttgctgaaattttctactcagttgcttccacatgtcattccttttagagttaaaaaagaactttttgttgtcaaagtatgtatcattggttcttcattgttgccacaagagtgataacttcatttatttactgcttatgttttctgcttgtgagactacaaagtttagcttgtttgcttcttcccaataatgaaattaatgctgtaactatgcatctaagaatgctgcttactaccaattatgtattacttat

SEQ ID NO: 91974 - DNA, 662 bp, Homo sapiens
tcagtgtaccttccttgtactatttacatagtttttatgaccatcctttttttcattagttgtatatgtacttaagatatttctaaagttttgtttttatagataatgctgtgataaacattgtactgtataaaatatgttctaagaattctcagtggaaggattattgggataaaggatatgaatattgtgatggtctttgatacatgttgacaagtcacttttgtaaagtagactaattgtacctttaaagaaaattcaatatctaaaaaatcctaagtccaggtttatcatcaggaatatataccttgttttgaatgttcccattttatatttgtatttattaaacagaaaactttgctatttaagagatgagacatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtagtcccagctactcgggaggctgaggcaggagaatggcatgaacccaagaggcggagcttgcagtgagccgggatagcgccactgcagtccagcttgggcgaaagagtgagactccgtctca

SEQ ID NO: 91975 - DNA, 214 bp, Homo sapiens
aaacagaagagaggggcatgaaagagcgggaaaaggcatcatgtataacagtccagtatgaagaggaagacgccaacggggctccaggctgaatggtgaagcagaatgaaaagttattttttagaaaaagaggatgcagcttataaacacttttcagtaagtttagcagactccttttagcattacagtgggtgatgtcagagtgaaatgtgcc

SEQ ID NO: 91976 - DNA, 541 bp, Homo sapiens
ggacatagggctgaacagttcacattgttaaaaataaataagttcctcgtttataattctgattaacacagaacatttataaaatacagcctctggaaaagtgacacaaaatgcattacaatatgtcattctcaatcttttaataatgaaaaatgtgagacgcccaagatcaaaggaggcacatgttcagggaactgtttcatctcagagcttgatggggacaggatgatggactgggttttaaaaatggactacctggtcagtttcatgtcttttgacctacctcggtatgggctgttttcctcatgtttataatctagtttaggagctttttcccatcctggctcgttggctggtttgaagcctcactttattcttcagaagggccttggtctgtccaccaccagatgtctcatgtgttatctgacacataccagcttcgtggatatcaaagggggaggattacagggccattgagatcaaaacagagcaaatttgatgatgaaccaggggaaacaggccaagatgtgtccctaatggg

SEQ ID NO: 91977 - DNA, 887 bp, Homo sapiens
gtaggaaggatttcatgtgaaactacaatttgataaaaaatgagagataatcactatgctttgctccagtcactaaaattaggtcccataggatcatatctttggtacaatgaatataggactgcataaatcaggaagtacagtaaataaggctttcaattcaatttaatatatgaccagctctcttttatcactgaccttcataccactgaatgtttacagatgtgtcatttatttaagattgctaagtgttggactgacttacaaaaattaatgtatgactcactcaaaatgggatacacattctcaggacagttttaggtatcttaaaaaacaaatgcactagctgtaaactttttcctagattatgaaatttcttttgacagaaaacataatccacaaaattgtctttatattttgaggaaggaggtatggcaactactttcaaaattacgtaaaaatgtcttgctgttaactactgctagtttacattgatgtcatttttctttaatgctctttttttttccagaaggaaatataaaagacaaatgtattaatttgtcaaccagttgggtaatacctctgtttaaatttcattcttaagcatactagtttaacaaaaaagtttaaatgataatttactctttgggaggtggaagcaggagtatcacttgagcccaggagttcaagatcagcctgggcaacatagtaagacccccatctctaaaaaacaacaacaaaaaattaggcgcggtggcacgcacctgtagttccagctacttgggaggctgaggtggaagatctcttgaggctaggaggttgaggcagcagtgagccgtgatcctgccactgcactcctgcctgggtgacagagtaagaccatatca

SEQ ID NO: 91978 - DNA, 106 bp, Homo sapiens
gtaggataacagcctttattcatatcactaattgtaatatgtactaattgtaaatgtggaaactgaagccccattccagagaagacattgctttttatgatagatc

SEQ ID NO: 91979 - DNA, 346 bp, Homo sapiens
gtggttttgatttgcatttccttgataactaatagtgttgaacaccttttcatgtgcttatgagccttttgcgtatgttctctggagaaatatctattcaaacactttgccaaatatttaattatttgtcttttcattattggtatgtaggagttgttcatttttaaaaccccactgactcctcttaattcccccaaccccctctgcatcccttaaggtagcagattaaggaacagaagtagcattgagtcaggagacacttctattgcttcaagagacagggtctcactacgttgccctgactgtatgtcgtgcagtggctattcacaggcccatgatcacagcg

SEQ ID NO: 91980 - DNA, 322 bp, Homo sapiens
gcatgtagcaggagattctaggctagttttctcagataatatataccttaaaaggaacttcaaataataaccccccccccccaaaaaaaagtggtatttttttacataccactccccaatgaacttgactttccttgagggtaggaatagggtctcttgtttacctctgtagccttagtgcctaaggcctcaataccttttcattgaatgtcaatgaatggatgagcagacaatgacaggtagaatgaagacatcaacatattgtagtagtgaaaaccataagctttggaggcagacaatcctgggtttgaatcatgctgct

SEQ ID NO: 91981 - DNA, 591 bp, Homo sapiens
aatttctaacatcataatttttaaaaaatatcggcgtgtaattcacataccatcagttgtacccatttaaagtgtacaaaggttgtcagcatattcacagttacacaaccatcaccacagtcttagaacactttcgtcattccaaaaaagaaccccgtttgcctgtgtttaacaatttgcctgtttataaatggaatcaaacagtatgtgcttgacttctttggctcagcttaggggttctgatacttactcatccccaatgtgtgtagttgtggtttttcagtcttgatgctgtgtctcacaatttattctactgatgatggacatgtgagttgtttctggtttttgcatggatgttttatatgtgtttcttggtgaatatacatctctctatttatattcacaagaatatataccaaggtatgaaatttctgggacatagggtatgtataaacttggctattagagttattgtcaaagagttttccaaaggaaaaccttataccagttaacacattcccacagcaggagttgagagttccagttactctgcctccttgccacacttgatatatcctctgtcattttcat

SEQ ID NO: 91982 - DNA, 1141 bp, Homo sapiens
atagggagggctcggccttggctccacactgcgctgcccagaggccccgctgactcctgccagcctccaggtccccgtggtaccaaagctgaacatggatgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaa

SEQ ID NO: 91983 - DNA, 1497 bp, Homo sapiens
atagggagggctcggccttggctccacactgcgctgcccagaggccccgctgactcctgccagcctccaggtccccgtggtaccaaagctgaacatggatgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaaaaacccccgggggggccaaatttttccccccccccttttttttgaaaaaagggccccctttggggggggtatataaaaccagggccaggccccggtttaaaaaacccttgggggggaaaaaattttttgggggaatttttggaaaaaaccccttttttggggggggaaaaaaatgggaaaa

SEQ ID NO: 91984 - DNA, 1192 bp, Homo sapiens
atagggagggctcggccttggctccacactgcgctgcccagaggccccgctgactcctgccagcctccaggtccccgtggtaccaaagctgaacatggatgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctctcagaccgtcttcctccaacccctctatgtagtgccgctcttggggacatgggtcgcccatgagagcgcagcccgcggcaatcaataaacagcaggtgatacaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaaaaacccccgggggggccaaatttttccccccccccttttttttgaaaaaagggccccctttggggggggtatataaaaccagggccaggccccggtttaaaaaacccttgggggggaaaaaattttttgggggaatttttggaaaaaaccccttttttggggggggaaaaaaatgggaaaa

SEQ ID NO: 91985 - DNA, 2260 bp, Homo sapiens
  misc_feature (741)..(741): n is a, c, g, or t
atagggagggctcggccttggctccacactgcgctgcccagaggccccgctgactcctgccagcctccaggtccccgtggtaccaaagctgaacatggatgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggtaagacgtggcccgtggtgctggcctctcctcgctgctcagagggtggtggcctcggtgggtggagagcgatggactctggtcttgctccgtcaggcaggtggcctcgtcccacttcatccccttgcagaggctgggcgagagcctgtgtccccactgcagccacgtggcagagcttcccctggcactggggagagggtggacaagggagcagcctgaatccacctttgctttcctccatcagctcatgacccatgtgtgctttgtaaggcaccagccacatactggaaaccccaagagcagcccatccaggcatgcgtggtggcgaatgccagctcccgggttcctctggtctcctgagtcccggagacctgggagcaggtgggggtcatagtcctgaaagccagagagcagggcgttcctagcacctcctccaatgagctcggcctgcccacggntagcaaagctcttggcaagtttacttaggtgccctgcaaggctaaaaggacaggcaatggacgcccccccccccacccaaccacaggcctcctctctgagccacgggtgagcggtgcaggttctgctgttctggagggcctgagtcccacccagcacctcataaacagggtcctccccagggctgctgcagtaggcatcaacgccagggtgcaaaatgcctcagggagccaaggctgagccaggggagtgagaaggagcatgtggaagtgcgttttggagaggcagctgcgcaggctgtcagcaggctccggccgcttctatagacagcatgacaccaagggcagtgacctcattccacaggctgagtccagccagccagccaagcatcaccagccagacgattgacctaacggaccaaccaacccgtaacgacccctcctaccataaccagtagccagccagcccataaccagccaacttatctataaccagccacctgaccatagccaaacaaccagccggcccaccagtagcattcagcccctcagctggccctgagggtttggagacaggtcgagggtcatgcctgtctgtccaggagacagtcacaggcccccgaaagctctgccccacttggtgtgtgggagaagaggccggcaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaa

SEQ ID NO: 91986 - DNA, 1534 bp, Homo sapiens
atagggagggctcggccttggctccacactgcgctgcccagaggccccgctgactcctgccagcctccaggtccccgtggtaccaaagctgaacatggatgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaaaggcaccacgagacacaaagaagacagacaacaaacagaagaagaaggagcaaccacgcagcagagagccgggcagaggcggggcccccagacagcaccgccccccgggggacacaagtaagaacgatggcacgagaagcacgcggcagacaccgcgaggaacaaaatggggagcagggagcgagaagccatagacacagaccagagacgccgcagagcgagccgccccgggcgacgcccgcgcccgcacggcggcaagacaggggcacagacgagaagacgagacgagagacgggaacacacgggcgaccgcgcccccggatccgaacaccgaccaacgaaggcgcgcagcagcgacgaagacgaaaacaaaagccccagcgccagacacca

SEQ ID NO: 91987 - DNA, 1876 bp, Homo sapiens
  misc_feature (741)..(741): n is a, c, g, or t
  misc_feature (1659)..(1659): n is a, c, g, or t
atagggagggctcggccttggctccacactgcgctgcccagaggccccgctgactcctgccagcctccaggtccccgtggtaccaaagctgaacatggatgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggtaagacgtggcccgtggtgctggcctctcctcgctgctcagagggtggtggcctcggtgggtggagagcgatggactctggtcttgctccgtcaggcaggtggcctcgtcccacttcatccccttgcagaggctgggcgagagcctgtgtccccactgcagccacgtggcagagcttcccctggcactggggagagggtggacaagggagcagcctgaatccacctttgctttcctccatcagctcatgacccatgtgtgctttgtaaggcaccagccacatactggaaaccccaagagcagcccatccaggcatgcgtggtggcgaatgccagctcccgggttcctctggtctcctgagtcccggagacctgggagcaggtgggggtcatagtcctgaaagccagagagcagggcgttcctagcacctcctccaatgagctcggcctgcccacggntagcaaagctcttggcaagtttacttaggtgccctgcaaggctaaaaggacaggcaatggacgcccccccccccacccaaccacaggcctcctctctgagccacgggtgagcggtgcaggttctgctgttctggagggcctgagtcccacccagcacctcataaacagggtcctccccagggctgctgcagtaggcatcaacgccagggtgcaaaatgcctcagggagccaaggctgagccaggggagtgagaaggagcatgtggaagtgcgttttggagaggcagctgcgcaggctgtcagcaggctccggccgcttctatagacagcatgacaccaagggcagtgacctcattccacaggctgagtccagccagccagccaagcatcaccagccagacgattgacctaacggaccaaccaacccgtaacgacccctcctaccataaccagtagccagccagcccataaccagccaacttatctataaccagccacctgaccatagccaaacaaccagccggcccaccagtagcattcagcccctcagctggccctgagggtttggagacaggtcgagggtcatgcctgtctgtccaggagacagtcacaggcccccgaaagctctgccccacttggtgtgtgggagaagaggccggcaggtgaccgaagcatctctgttctgataaccgggacccgccctgtctctgccaaccccagcagggacggcaccctctgggcagctccacatggcacgtttggatttcaggttcgatccgaccgggacaagttcgtcatcttcctcgatgtgaagcacttctccccggaggacctcaccgtgaaggtgcaggacgactttgtggagatccacggaaagcacaacgagcgccaggtgagcccaggcactgagaggtggganaggggggcgagttgggcgcgaggacaagggggtcacggcgggcacgaccgggcctgcacacctgcaccatgccttcaaccctgggagagggacgctctccaggggaccccgaatcaggcctggcttttccccaagggaggggccgtgcccacctgagcacagccagcccctcccgtgacagaggtcaccattcccgagctaatgtggctcagggatc

SEQ ID NO: 91988 - DNA, 2367 bp, Homo sapiens
  misc_feature (741)..(741): n is a, c, g, or t
atagggagggctcggccttggctccacactgcgctgcccagaggccccgctgactcctgccagcctccaggtccccgtggtaccaaagctgaacatggatgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggtaagacgtggcccgtggtgctggcctctcctcgctgctcagagggtggtggcctcggtgggtggagagcgatggactctggtcttgctccgtcaggcaggtggcctcgtcccacttcatccccttgcagaggctgggcgagagcctgtgtccccactgcagccacgtggcagagcttcccctggcactggggagagggtggacaagggagcagcctgaatccacctttgctttcctccatcagctcatgacccatgtgtgctttgtaaggcaccagccacatactggaaaccccaagagcagcccatccaggcatgcgtggtggcgaatgccagctcccgggttcctctggtctcctgagtcccggagacctgggagcaggtgggggtcatagtcctgaaagccagagagcagggcgttcctagcacctcctccaatgagctcggcctgcccacggntagcaaagctcttggcaagtttacttaggtgccctgcaaggctaaaaggacaggcaatggacgcccccccccccacccaaccacaggcctcctctctgagccacgggtgagcggtgcaggttctgctgttctggagggcctgagtcccacccagcacctcataaacagggtcctccccagggctgctgcagtaggcatcaacgccagggtgcaaaatgcctcagggagccaaggctgagccaggggagtgagaaggagcatgtggaagtgcgttttggagaggcagctgcgcaggctgtcagcaggctccggccgcttctatagacagcatgacaccaagggcagtgacctcattccacaggctgagtccagccagccagccaagcatcaccagccagacgattgacctaacggaccaaccaacccgtaacgacccctcctaccataaccagtagccagccagcccataaccagccaacttatctataaccagccacctgaccatagccaaacaaccagccggcccaccagtagcattcagcccctcagctggccctgagggtttggagacaggtcgagggtcatgcctgtctgtccaggagacagtcacaggcccccgaaagctctgccccacttggtgtgtgggagaagaggccggcaggtgaccgaagcatctctgttctgataaccgggacccgccctgtctctgccaaccccagcagggacggcaccctctgggcagctccacatggcacgtttggatttcaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaa

SEQ ID NO: 91989 - DNA, 389 bp, Homo sapiens
tccgcctcctgggttccagcagttcttgtgccacagcctcctgagtagccgggaatacaggcatgcactaccacacctggctaatttttgtatttttagtagaggcaagagtttcaccatcttggccaggctggtctcaaactctcctgacctcaagtgatccgcccacctcagccttccaatgtgttgggattacaggcgtgagccaccgcgccttgctctatttattttcttgatcgtgatggtggttttacaggtgtctacatatgttaaagctcattaaaattgtgtactctagatacgtgcagttttaaatatgtcagagaaagaaagaaaaggatacttcaaaataccagaaatgggcaacagagcgagactctgtctcaaaa

SEQ ID NO: 91990 - DNA, 276 bp, Homo sapiens
tgggcaggtcagcaggtgcaggagaggctaggagggcggtgactggatgatgaaggggcatttgtttatttatcctttgtttttgttttttgttgtttaaattgagaccagctctcacaatgttgcccaggctcgtctcgccaactgtctgcccactcctggcctcaaacgatcttcctgcctcagcctccaaaagtgttgggattacaggcataagccaatgtttattcgtcctgagccttccctggacacctgatatgtagctgctttgtggtg

SEQ ID NO: 91991 - DNA, 335 bp, Homo sapiens
atgagtagataccatgagaattaagtgactcaatatagatgacttgcactcataaaatgctagtgctttgttattattattgttattattcagaatcccttgttcaacctgccttgatccatgaccattctggcagatattatcagggaacaatattgtttcatgggccagtgacccatgaagagtcatgctccatccttccctagaactctgtcttcctgaggcaagaccataggctttccaccagtgtcctccgtgacagtgttccaccatgacaatcatgctgtcctctgattgtcagaagttatttatagggaaggaaaggaaaaggaagg

SEQ ID NO: 91992 - DNA, 299 bp, Homo sapiens
atctattgaagatgactgctttcttctactgtagctggcaattttatgaaatgaagaaaatttgctctagttgcaagtgacacacacctcttaaatgtctgctatcaattaaaagtaaaatactggttacttgcaactatcaattagatacaatgcactccaggagatcaggagccttggcattcagacataggagcatttttttggctttgccatttacttgcaatgtgaccttggtaagtgacttaacctctttttcagtttctttatctataaaatgaaacctcatacagtacctg

SEQ ID NO: 91993 - DNA, 599 bp, Homo sapiens
gattatagacatgagccactgtgcctggcccagtgtggaaaattaagtgaggcatgtatgatgagaacggctgcacgtgggagatgctccgtggatgtttgtagaacgctggcttccgtgtttcctcgttgtggctgtggtggtgtgggtctttgcctgtggacccgtggaagacaaagaagacagttttggatggtcaagctattttcttgcttcagggctccctcccctgctttttgaagcctcacaaaccaggactgtgagggcaggaaggcttggggtctttgtgtgctgagcctcattagggttttaagaacctccctcctttcatctctagcttacgagagggatgattcattatcttccctcctcaggctgcagtagaagcagacagtctctgcctccctgcttgcctttcctccctcccattcactgttgattattgccctcaagaataacaggttgcccagctactcgagaagcttaagtgggaggattgcttgaccccaggagttcgaggctgcagtgagctatgatcgcttcactgcgctatagcctggcagacacagagagaccctatctcaagcaaacagacaaac

SEQ ID NO: 91994 - DNA, 295 bp, Homo sapiens
aaaagtgatatcttagttctaactacctaagtcagcagcaaagtttaaacagtacagatttaaaaattttttataaaggaatttaactcttgttaactatattatatttagctttattgtactggatatctgtatttactgagtatacctatatgggagtcccttatattactttggaataacagtttttcatatataaaaaatgttgtgaaacttactgggagtgtatgtaatatgctttctaaggtaaattataaaaattaaaaccaaagtgtgaactactgagtactgcata

SEQ ID NO: 91995 - DNA, 144 bp, Homo sapiens
gacattgacactaagctttatttaataacctttaactgcaatggcatttttctctctccttttttttttgttatccagttaggttccctctattctttattttcttatctagagaaatttggcaactgtctgtaagttcagatc

SEQ ID NO: 91996 - DNA, 435 bp, Homo sapiens
acctgaaattatcaggaagtaattaaccttaatatggaactttctacactgctgtgtatttatgtctagattttgtgaaaataaaagtagtaatatggctgatttttggacaagtgagtttgaaccttgggattaacattttatttttattttttagtctgtaaaatggtttttttgtgctagatgaatgtatcagcttatgtaaatacgaatttaataaaattgccaaggtgtatggtttatttgggtgaggcactgtgtgattattgaacctcttaagcaagagaatatcttgatgatcatctagttccactctcatttatacatgaggaacctggtattgaaactaatatcagtatcccgaaggaaggagggtaattggagaaaaatcagaaataaaaggtaattgattagaaggtgaaagttaaaaaaaaa

SEQ ID NO: 91997 - DNA, 213 bp, Homo sapiens
tgggagatgtgatgggtgcactgtggcctccggatcagcggaacctcaggccctcctggttaacaggaactgccattggccccagccaaaaggcaggtgagggcagggccctgtgctgccatctccccttcctgcctcatgggtctcactgcccaggctcagggagcgcataagtaatcctaactgagcactatggctgctctgagacagtgg

SEQ ID NO: 91998 - DNA, 558 bp, Homo sapiens
ggcgcagtgagcactgagccacggaaactcaactctgccatgtcccacaggcaagcatgaatcaggatgacagtcaatgccacaaaatccaaagccgtgtgggtgcttttttgactagagacagagcaagggcaggagtgaagcttaggcttctgcaccaacccagcgagacatcagtcatctctaagcactgcagctctctgcccctctgattctcaaaggaagaccacaaggaccatattccatggagtcatagctacaggataatatgaagtttatattgccattgaagaggcagagaggagctgcagcatgtattcacaactgagaacttgtcctgtgaaggaagaaaacaatgccccttggagcaaagaattaagagatgacttatatttgaaaaaccacccacagctgcatgttgatgtgctcgagtggcttgttgatgctgcctgaagttggggttctggctgtaccagttatttaccctttgattaaaaaaatactttaattctgattgaaaatcaccagaaatgaaataaaaagacaaaacagaattcc

SEQ ID NO: 91999 - DNA, 377 bp, Homo sapiens
tagagactgggtcttgctctgttgtccaagttggtctcaaactcctgggctcaagctctcctcccaccttgacctcccaaagtgctgggattacaggcatgatccaccatgtgctgccaaaatatttaccttaggggaaaaaacagggcttgaataaacactattaaaaacctatataaccccatactagtagagatcaggatgcagggaatctggggtttgactcaagtccactaatcttcatcctacttctgaatattcctatcatgatatatagtatttcatgttttccattcttctaagtgacacaaaaatatctagtttttgtgtttgcacagtgcctttcagaatgtcccacccatagagtagcagttatg

SEQ ID NO: 92000 - DNA, 232 bp, Homo sapiens
atagaaaagcccaaaccatcagaaatgagttacggtgcataactggatcaagacttttttacacaaaaaccaaataacatgtacaagtttaatgccaacgtatttgaaaatcttaggtaagatagatacttttctgaaaaaatataaatttaaaatatagtcatatggtagtagaagatcctaaactacgtagaaaaaatcgaaaaggtgttatgagatttgtccctaagaa

SEQ ID NO: 92001 - DNA, 504 bp, Homo sapiens
gtacattgttggccatgcttggacatcagcaccaatatatattttgtaagaaaaaatattagatctcactaaattagttgtaacagactttattcataacctaatttcaagcagcaaagagattgtttggaaaacagttcttgctaatactttaagatgcttctccttcctgatgaagtgcctactttttttttttaacccacaaaaaggttaatagggctatatttgcatatcagttccatttttagaaggttaatagtctccaagttacaaagttgtgatctcattgccatcctagaaactgttgaaatgacgatgttaaaactaagaaattatagactaaataaagtgctttttgagcactttaagccatgaaacagtggcgagaaaacagaagtcctcttctctaccacaggaggcacagtgatacaatactgccacctcacagagcctgaataggtgaatatttactttcttacatctaagacctaaatatttcctggg

SEQ ID NO: 92002 - DNA, 567 bp, Homo sapiens
ggcagaatatgaaacttcctccttcttcctgatacctttcccagaggcagccctgtgacatctcctatgccagcataggaggagaatcttccctgtccatctgttttctcctaaataattgttttcatgtttctcagagactgggtcttgaaccccagggctcaagtgatccacccacctctgcctcccaaagtgctgggattacaggcgtgcgacactgcacttggctctcttcctctatttttaatagaatccattaacatacctgccatacttattgtctttttttctctcaactttttatgaaaaatggcaaagacacattttgctgtgtttgctttgtcactatacatccccacggacgcacacacgcttccgtctggccatttgacttcacaacccttcactcctaaatacttcaacgtgcctaataaggtttttctcccatggagccataagagcaccatcagatctaaaataagatcaatagtcccacctaacaaccacttttattcactccagcccgggcaacaagagcaaaactccgtctccaggaaaaaaaaaaaa

SEQ ID NO: 92003 - DNA, 816 bp, Homo sapiens
ggcagaatatgaaacttcctccttcttcctgatacctttcccagaggcagccctgtgacatctcctatgccagcataggaggagaatcttccctgtccatctgttttctcctaaataattgttttcatgtttctcagagactgggtcttgaaccccagggctcaagtgatccacccacctctgcctcccaaagtgctgggattacaggcgtgcgacactgcacttggctctcttcctctatttttaatagaatccattaacatacctgccatacttattgtctttttttctctcaactttttatgaaaaatggcaaagacacattttgctgtgtttgctttgtcactatacatccccacggacgcacacacgcttccgtctggccatttgacttcacaacccttcactcctaaatacttcaacgtgcctaataaggtttttctcccatggagccataagagcaccatcagatctaaaataagatcaatagtcccacctaacaaccacttttattcactcatcccaaatgtctctctttatttttttgagacagtctctatcgcccaggctggagtgcagtggcactatctcatctcactgcaacgtccgcctcctgagttcaagcgattctcctgcctccagctccagagtaactgggattacaggtgcccgccaccacacccagctaatttttttatttttagtagagatgagatttcaccatgttggccaggctggtatcgaactcctgacctcaagtgatctgcccacttcggcctcccaaagtgctgggattacaggcaagagccaccgtgt

SEQ ID NO: 92004 - DNA, 434 bp, Homo sapiens
tgtggtgggatacctgtaatcccagctactccagaggctgaggcaggagaatcacttgaatctgagaggcagaggttgaagtgagcagagatcataccattgcactccttccagcctgggcaacagagcaagactccgtctcaaaaaaaataaaataaaatttgaatgggatacttctaagactgctgacaaagaggggacatcgtttgcccctccctggttcttcttactctgctaaatccaataatcccagaggtgcagttttgacctcagccgtggccctggggtgttctgcagccacctgctggggagcagggccaccttggccacctcagctggttgttgactccagggaaggctggctgccagtggtggctgccatgccaccaccatctccggcctgcctgccgtcgctctcccttgcttaatcccag

SEQ ID NO: 92005 - DNA, 577 bp, Homo sapiens
aattaaatgcattgtaatatgaaaggcagagtgtaaataaagtgttcatgtttactaagaaaacagactaagatattccaggtagctgaacacactttgataataaaatttgaaacagcttcttggctttcattctatttaaaatatttatgtagttaaaaaaaaaaattgactatttattttctatctaaatgcaggaaatgctgagacattttaaatgagtagagattgaacatacataaataagcgtcctgtttcagctacggaattataatacttccgagctgctccattcatacctcagcaaacaaccagtccaattcaatttagagaagaatgccagcctcaaattcaatttatttaatatttaagttttgtgaaagtgctgagttaaaggagttatctcagcgaaattaaaacactgctaatctcaattcaaaatcaattttctttccaggacaattcttgggaacctcaagaatctcttgctgtatatcataaggagtatacattcaagaactgatatctaaaagaataagtacattcgtataaaaaagattccttataaaataggatc

SEQ ID NO: 92006 - DNA, 319 bp, Homo sapiens
tttttgtagagacagggtttcactatgttgcccaggctagtcttgaactcctggcctcaagttattctcctaactcagccttctgaagtgtgggattacaggcatgagccaccgtgcatagccaaaattcaggctttctatgcccatgatacaagaagtagtagctcatgttttaggggctggtagtatacaagaaaatttgaaacagaattttgacaaatgtgaatgtatgcagggaatgaagctaatatatcccttcattcttatatcccaataagtaaacagaactggagcctttagttattattatgaacatgtg

SEQ ID NO: 92007 - DNA, 387 bp, Homo sapiens
ggttcaagcaattctcctgcctcagcttccagagtagctgggactagaggcatatgccaccatgcctggctaggttttttgtatttttagtagagatggggtttcaccatgctggtcaggctggtctcaaactcctgacctcaaataatctgcctgcctcggcctcccaaaatgctagggttataggtgtgagccaccatgctcagacaaaaacaagttttaaaaaagtcattaagaactggtttgttacagcagtgtatcttatctgttgactataccacagctttgaattgtataaccgcttaatgtctgttcattcacagagctaaccagcagataacataatgttaacaaaaataaccagaaaattaatatcacttgtccttc

SEQ ID NO: 92008 - DNA, 356 bp, Homo sapiens
gcaaaactgtgtacatttcttttagtacatctatctctactacctggttgctcacatcctaggtatagacaactgcaaagaactggtgtcattagtttttaaagaacttttgaccagagaggccaaatgttgtttaaggtaactttatgataacaaaggaatgtaacatttattgaacatctgctttatggaggtacttttgcttagtagttttgtgaattacgttattcaacttttcagcccagtgaagtgaatgtcttgatatccacattttacaaatgataaaattaggaaaacgacagcaaagttaaagactgatcagggtaggttgaatagttatctattgaacagtttct

SEQ ID NO: 92009 - DNA, 581 bp, Homo sapiens
ttcttattatttatccagatttatcaaaagtttattaaatagaatacaatggcaaaattcaaggcttttaacaattgagtggtaaagttcaagtggaagaaagcaaaactcagaggagtaagagaagaaaagaacaatattttgcctatgccatttaattcccacaaatttgcaaagtgagcattgttattctcagtttccagatgaatgcactgaaataatttggatatttatcctctccaaatttcatgttgaaatttggaggtggggtctggtgggaggtgttttggtttactcagccaaagaatttagcttctttgatttgaagctgagatttgaacccagggtcctttgattccaagcccagatatttaccacaatatctctgtgatcatccaatttatatgtctcaagtatctgtgccattgacaaattgtaaaactgtgcatgtatacattatacctcctaaggttgagacatagatggaagtgcccagcaaaacgtctggcacaaaggcattattttttgttttggctttgggctaaaaaaacatagataacaagcaaatgctttggagccct

SEQ ID NO: 92010 - DNA, 356 bp, Homo sapiens
accttctgatctgtttctatcaaaccaaacctgtttctcctagagtcatccccaccccattaaatggactttacatttttttctattgcttgggtcaaaaacttggagtcatccataacacctgtctttctgtctgcccacatcctatctaccatcaaatcctgtgtgctctaccttcagaatagatctaatgattacttctcactctctctactcttaccaccctgatctaagccactttcacctctcatctagaatattgcagtagcctcctaactgatcttcttgcttccattctcacccctcattttcaacccaacagccagagtggtcctatgaaaatatagttacatcac

SEQ ID NO: 92011 - DNA, 229 bp, Homo sapiens
aagcaggtcaaggctgcagtgagctgtgattgcaccactgcaccccagcctgtctcaaaaacaaaaacaaaaaacgaacctggggcctgggaaattgtgtgttaattcccttgaggtgacttttgcattggctacagtatgagaaccactggactggttcaccagaagggactgaaaggtttcagggaaggatggggcatatttggtattttcagggtggttatacagc

SEQ ID NO: 92012 - DNA, 308 bp, Homo sapiens
agcatttctacccagtcaatgttatcttggaggagaagacaagggaagatggaaagccattcactcatttattcattaaattgatagatttgggatatatctaataggttctagccactctgaggtgctgaccttttaatggtgaacaaatacagatacagtttccatgacatatattttaaaattatcatacaaataaacatattacaactggaaatgaatgctaggaaggaaaagagacatttgaactgtcccttcttaacagtgcccagaattctgcagtagatttgaaaatatttcatcatttt

SEQ ID NO: 92013 - DNA, 276 bp, Homo sapiens
catatacttgcatttgttcaagaagttgatgaggaacatgaggagagtgttacaacttagcccaagctctatgactacgggtggctctggactgatgagaccacttcctctcatctatccatagcccctacagacgccactccagctgccctccctactccacctcagccacagaacaagcccagcccacccacgtagctacccttggtcaccacattactgccaccttgtctaaataatccgcggcgcgggtggggcaggctccggtctccttgc

SEQ ID NO: 92014 - DNA, 944 bp, Homo sapiens
ctggtttgtagggaatcaaactccctcattatttgtgttcacttctggtaattaagcatttaaacagcacttgacattcagcaaccatttttataagcattcctcttaagaacctagaacaccatcaattcgatagcactgtctttgtaaggcacaaactgatggtggctaaggaccaagaaagcttctcccttctgtgtgaaggtgatgctactccccttagggaaaccactaagcttcttttccaacagcagtttctggtttgtgctaatttgtggacagtctttctggtctcctcttgacagatggcaggtgtttcagaactttgaccctgtcctgaaaatgccaagcatcatatggccaaagtggaacacaacatactgacttagaaataatggtcatgtaatgaccccatgttaagctgctctaggaggttataattttttgtttgtttgtttttgagatggagtttcgctcttttcgcccaggctggagtgcaatggcgcggtctcagctcactgcaacctccacctcctggggtcaagcaattttcctgcctcaacctcctgagtagctgggattacaggcttccaccaacatgcccggctaatttttgtatttttagtagagatgtggtttcaccatgctggccaggctggtctcaaactcctgacctcaggtgatccacccacctcggcctcccaaggaggttatgatttaaagggaacttacacattttgttttgtttaaatcatggagaacaatgaaaagaactattatttatatttggagcaagccaaccactaaaggaataaactcagtgcttaaaatggattgttttctccctcacctgttgaggaaaagattctttaaatgaatttaataaatgtactgtgcactaaccacaagccagcacttggaagaaaacagtgacccaggatcaa

SEQ ID NO: 92015 - DNA, 391 bp, Homo sapiens
cctcaacctcctgggctcaagcgatcctccccaagttgctgggactacaggtacacgccgctgtgcctggctaatttttgtattttctgtagagacagggtttcatcatgttgtgcagtttcagtccataaaaagtaaggagtgattattattaaaagagggattggtgtcgagaaggcagcctcttgatatttcagcagtgaggaagtactgatggcatcgtggtaatcttgcactcttgttaatgcaaacttcttttgagagcttaagctttagaaaggctggcagttctgggttttaattctctgtcaccttgtgacatcagacatgttacttaatttctctgcttcactttcctcatctgcaacatgggaactctgcaacacagcta

SEQ ID NO: 92016 - DNA, 485 bp, Homo sapiens
ggggacaggcaagagggaagaaagtgatatgtattagactgttctattcctggccacagagagagaaattctgaggcatgtcacagtgcttgatgtgaaagcctagtaagtcaaaacgggaagaaatactttcagaatcctaatggtcctattgccagagtataagttatgaggaatctggtgtatctatcatctagaaaccaaacaaaactaaaaatcacaggggaattactacaggttaaaaaaaaatgtctattttaaagatttagagatagattcaaatagctagaggagggtctgagctatttttttattacaataaggcacacttttaaatgcctaatgtccttttgttttaggggggcttgtttgttgttttgtttgtttgttttgagacagggtctggctctgtcacccaggctggagttcagtggtgtgaccttgcctcactgcagcctcctccaacccttctccacacaacttcc

SEQ ID NO: 92017 - DNA, 169 bp, Homo sapiens
ttcctctactccttcccacctccccttaggaattaacctaatagaacatattaagactattatgaggctaggtgcagtggctcatgcctgtaatcccacacttagggaggctgaggtgggaagattacttaagcccaagagtttgggattagcctgggcaagatgacaa

SEQ ID NO: 92018 - DNA, 365 bp, Homo sapiens
agaagtttcatagtaggctgtctgcaaactggagaaccagggaagctggtagcattcagtccaactcagaaagcctcagaaccacggaagccagtggagtaactctcaatccaaggctgaaggcctgggaatctggtaagggttggaggacactggtatgagtcctcaagtccagaggccatgaagcctggagttctaatgtccaagagtaggagaagaaggtaaggtattccagctccaggagagaacacaatttgcctttcctctgcctttttgttgtatccaggcccccagcctattggatggtacctacgcaaactgagggtggatcctcccactcagtccacccactcacacaccagtat

SEQ ID NO: 92019 - DNA, 709 bp, Homo sapiens
tatttagtatatatttaaggttgtgattttctcctaagcacagggttattagcccatggatttttatacttatcactctttttaaacctagatgttctaaagcaagcttgtccaacttgcagtccatgggctgcatgcaacccaggatggcttcgaatgcagcccaacacaaattcatactttcttaaaatattatgagattttttttttggaattttttttttagcctatcaatcagctatcattagtgttactgtattttatgtgtggtctaagacaactattcttcttccagtgtgggtccagggaaaccaaaagactggacaaccctgtcttaaagtttgatttctctttaatccaggattttttaggcatatgtaaatttttagatagttaagagactttgttgtttccatgtttatattaatttctagttttattctattttagagaatttagcctatagtatttcaacgttttggagttccttcctctattaatatataactaacttttgtaaatgcccaattagcactgaaaggtatatttcttttttccaagagtatcagttcttcttaaccctttttacttgtctattgcacaattaaaaaggtatgacacattttgggaggctgagacaggatgatcgcttgagtccaagagttggagaccagcctgggcaacatagagaaagccggtctccaaaaaa

SEQ ID NO: 92020 - DNA, 408 bp, Homo sapiens
cccttcacagccccaacagcgcctccactggcattctttcccccaaggcaactagctagggggaaggaagagctccctccctccccaggtcccagaaccccaccctcatccctctgctcttagagtcttatttctaccaggagcccagctggaaaagctccttgtcatgtcatcccatttgtccttacccctgctgaggggacaacagcttccctggggccttcagtccctaaacaatagccagaccgtttctcagcacctcatcattttctttttcaatttttaaaaattagcacataattgtacatatttttagaatacacagtgatgttttgatacatacaatgtatagtgatcagatcagggtaattagcatacccattatctcaaacatttctcatttatttg

SEQ ID NO: 92021 - DNA, 416 bp, Homo sapiens
tcagtagagacagagtttcaccatgttggccaggctggtctcaaactcctgacctcagttgatccacctgctttggcctcccaaagtgctgggattacagctgcgagccaccgcacccagccagagaattcttaaaatgcagataactggtaagggtcttggggaggagctacccaaactcatttctccccttagccaccaaagaacagggatgagtgagtctggagagttttttcctaacaccaaatacatggtattgtcagaggcgtttgaatcagagagactccatcttgaataggagctgggtaaaataaggctgagacctgctgggctgctttcccaggaggttaggcattctaagtcacagagtgagacaggaggtcggtacaaggtataggccacaaagaccttgctga

SEQ ID NO: 92022 - DNA, 390 bp, Homo sapiens
atcttgctaacttataactctagcacttagcagtatttgacacccaacaaataaacggtttttgcaaaaaagaagctcacaatgtattagggagattattaggcaaatatccagaagcagttaagttacttctctaatacagtctagcatcggtcataaaaaaaatagcattaggccaatcatcttttctcccttacagaaatgaaagacatgaattaaggtagtacaattcctattccatttctacctccctgagctcagtgacccaagactagactcagttgagctgtatatccaataaagctttgttgaagaagaatctttatttgccttccaggaaaagaatttcttctttaagctaacgcagttaatgtcaactttgaaagatag

SEQ ID NO: 92023 - DNA, 4395 bp, Homo sapiens
ccagctacgagtggcagcaagaaggcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccacagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccatcagcatccttcctggaggacaagtggagcctgaccttgtcctagaggaggttgaaccgccctgggaggatgcccaccaggatgtcagtaccagcccacagggtacagaggtggttccagcttatgaagaagagaacaaagctgtggagaagatgcccagagagctgtcccggattgaagaggagaaagaagatgaggaggaggaagaggaagaggaggaggaggaggaagaggaggaggtgactgaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtgcctgccacgaaacagcacccagaagtgcaggtggaagatactgatgctgatagctgccccctcatggcagaagagaatccaccctcaaccgtgttgccgccaccgtctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgatggccaggaccgtgcggcctccacggccagcacaaatagcgccatcatcaacgaccggctccaggagctggtgaagctcttcaaggagcggacagagaaagtgaaggagaaactcattgaccctgacgtcacctctgatgaggagagccccaagccctccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgaccaacctgatgtatgtcctatggctgttcttcgtggtgatggcctggaattggaactgttggctgattcccgtgcgctgggccttcccctaccagaccccggacaacatccaccactggctgctgatggattacctatgcgacctcatctacttcctggacatcaccgtgttccagacacgcctgcagtttgtcagaggcggggacatcattacggacaaaaaggacatgcgaaataactacctgaagtctcgccgcttcaagatggacctgctcagcctcctgcccttggattttctctatttgaaagtcggtgtgaaccccctcctccgcctgccccgctgtttaaagtacatggccttcttcgagtttaacagccgcctggaatccatcctcagcaaagcctacgtgtacagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgcgggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggcgcatgctgagaagcaacaataagcccaaggaggagaagagcgtgctgatccttccaccccgggcgggcaccccaaagctcttcaacgctgccctcgctatgacaggaaagatgggtggcaagggggcaaaaggcggcaaacttgctcacctccgggcccggctcaaagaactggccgcgctggaggcggctgcaaagcagcaagagttggtggaacaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaaggtggggtgaggcggatcccgcgcgcagttccagcaggtgtgtccccagcgcccgctgcgcccctcgccccagcgccccaccttcccccacggctcaagagaagatgcttttccgtagtcgtgacctcagtggctgcagctctgaccgtcccgccagcacgccagccccgactcagctcctcgcggggctgggcctgagctcgacaagttgcatcaagtgttcgagtccctgagctctcactatcatttgagagccctaccttttcctgactgttcctctttttaagaacaaaatgattttccacttttaaagttcatgggtgagggataaaatgaggctccaatacatgggaagctttgctgaaaaagtaaagtgttattgaatgtgtggggtttcccctcaggaatttgtctaacacatttcaaggatagaaaatacttcactgccgggcatggtggctcatgcctataatcccagtgctttgggaagccgaagcaggaggatcactggaggccaagagttggagagcagactgggcaacatagcgagacctcatctcaaaccggaattcgg

SEQ ID NO: 92024 - DNA, 3453 bp, Homo sapiens
ctgccattccctgcacatctcctcaatctgattagaagcaggaaggattgctggctcctctgccactggagccaccctggctcgggagctgggctcccacttgcatgcaccgacccaggcttgggatgaacgccacagcccccagctgaacccctgcaccatgggcatcctgactggtcccgaccgagagatccaaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtccccagggtcactcctctgcctgagactctctggccccagcaccatggctacaccatgtcagaacatggagctgaatcgcctagtccaggaccagatacctggccaggtggcctctgcctctgccctccaaaacctggtagagcatctccctaatgtgcccagctaccgcatcccaatcacccgcatccctgtcctcacctcccggagaaccagcttgtccaactccagcttcgccaaggagaccaggagctccatccggcaactagtgcctgccacgaaacagcacccagaagtgcaggtggaagatactgatgctgatagctgccccctcatggcagaagagaatccaccctcaaccgtgttgccgccaccgtctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgatggccaggaccgtgcggcctccacggccagcacaaatagcgccatcatcaacgaccggctccaggagctggtgaagctcttcaaggagcggacagagaaagtgaaggagaaactcattgaccctgacgtcacctctgatgaggagagccccaagccctccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgaccaacctgatgtatgtcctatggctgttcttcgtggtgatggcctggaattggaactgttggctgattcccgtgcgctgggccttcccctaccagaccccggacaacatccaccactggctgctgatggattacctatgcgacctcatctacttcctggacatcaccgtgttccagacacgcctgcagtttgtcagaggcggggacatcattacggacaaaaaggacatgcgaaataactacctgaagtctcgccgcttcaagatggacctgctcagcctcctgcccttggattttctctatttgaaagtcggtgtgaaccccctcctccgcctgccccgctgtttaaagtacatggccttcttcgagtttaacagccgcctggaatccatcctcagcaaagcctacgtgtacagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgcgggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaaggtggggtgaggcggatcccgcgcgcagttccagcaggtgtgtccccagcgcccgctgcgcccctcgccccagcgccccaccttcccccacggctcaagagaagatgcttttccgtagtcgtgacctcagtggctgcagctctgaccgtcccgccagcacgccagccccgactcagctcctcgcggggctgggcctgagctcgacaagttgcatcaagtgttcgagtccctgagctctcactatcatttgagagccctaccttttcctgactgttcctctttttaagaacaaaatgattttccacttttaaagttcatgggtgagggataaaatgaggctccaatacatgggaagctttgctgaaaaagtaaagtgttattgaatgtgtggggtttcccctcaggaatttgtctaacacatttcaaggatagaaaatacttcactgccgggcatggtggctcatgcctataatcccagtgctttgggaagccgaagcaggaggatcactggaggccaagagttggagagcagactgggcaacatagcgagacctcatctcaaaccggaattcgg

SEQ ID NO: 92025 - DNA, 1767 bp, Homo sapiens
gttcatgcgctgtgttccttctgcagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgcgggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaaggtggggtgaggcggatcccgcgcgcagttccagcaggtgtgtccccagcgcccgctgcgcccctcgccccagcgccccaccttcccccacggctcaagagaagatgcttttccgtagtcgtgacctcagtggctgcagctctgaccgtcccgccagcacgccagccccgactcagctcctcgcggggctgggcctgagctcgacaagttgcatcaagtgttcgagtccctgagctctcactatcatttgagagccctaccttttcctgactgttcctctttttaagaacaaaatgattttccacttttaaagttcatgggtgagggataaaatgaggctccaatacatgggaagctttgctgaaaaagtaaagtgttattgaatgtgtggggtttcccctcaggaatttgtctaacacatttcaaggatagaaaatacttcactgccgggcatggtggctcatgcctataatcccagtgctttgggaagccgaagcaggaggatcactggaggccaagagttggagagcagactgggcaacatagcgagacctcatctcaaaccggaattcgg

SEQ ID NO: 92026 - DNA, 466 bp, Homo sapiens
aagcagacattgaaacatccaactggcccagaaacagctcatttggggcagcttctgagaagcagttccagactgtaattggtaagaacttctgggtgggcacccaggttgctgttgctgttgaggagggttgtggagttcactccagaagagcaccttgggttctgcacacagagcttgcagtagcttgtataatggtgccagggtcctctcagatctggatccaaggtctgcagttgggacccttctctctgcatcctctacctgggcctcagggctggttcagatggtcaccaatgtcatcccacagccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgacca

SEQ ID NO: 92027 - DNA, 4382 bp, Homo sapiens
gaattccgatggcagaagagaatccacctgcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccacagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccatcagcatccttcctggaggacaagtggagcctgaccttgtcctagaggaggttgaaccgccctgggaggatgcccaccaggatgtcagtaccagcccacagggtacagaggtggttccagcttatgaagaagagaacaaagctgtggagaagatgcccagagagctgtcccggattgaagaggagaaagaagatgaggaggaggaagaggaagaggaggaggaggaggaagaggaggaggtgactgaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtgcctgccacgaaacagcacccagaagtgcaggtggaagatactgatgctgatagctgccccctcatggcagaagagaatccaccctcaaccgtgttgccgccaccgtctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgatggccaggaccgtgcggcctccacggccagcacaaatagcgccatcatcaacgaccggctccaggagctggtgaagctcttcaaggagcggacagagaaagtgaaggagaaactcattgaccctgacgtcacctctgatgaggagagccccaagccctccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgaccaacctgatgtatgtcctatggctgttcttcgtggtgatggcctggaattggaactgttggctgattcccgtgcgctgggccttcccctaccagaccccggacaacatccaccactggctgctgatggattacctatgcgacctcatctacttcctggacatcaccgtgttccagacacgcctgcagtttgtcagaggcggggacatcattacggacaaaaaggacatgcgaaataactacctgaagtctcgccgcttcaagatggacctgctcagcctcctgcccttggattttctctatttgaaagtcggtgtgaaccccctcctccgcctgccccgctgtttaaagtacatggccttcttcgagtttaacagccgcctggaatccatcctcagcaaagcctacgtgtacagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgcgggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggcgcatgctgagaagcaacaataagcccaaggaggagaagagcgtgctgatccttccaccccgggcgggcaccccaaagctcttcaacgctgccctcgctatgacaggaaagatgggtggcaagggggcaaaaggcggcaaacttgctcacctccgggcccggctcaaagaactggccgcgctggaggcggctgcaaagcagcaagagttggtggaacaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaaggtggggtgaggcggatcccgcgcgcagttccagcaggtgtgtccccagcgcccgctgcgcccctcgccccagcgccccaccttcccccacggctcaagagaagatgcttttccgtagtcgtgacctcagtggctgcagctctgaccgtcccgccagcacgccagccccgactcagctcctcgcggggctgggcctgagctcgacaagttgcatcaagtgttcgagtccctgagctctcactatcatttgagagccctaccttttcctgactgttcctctttttaagaacaaaatgattttccacttttaaagttcatgggtgagggataaaatgaggctccaatacatgggaagctttgctgaaaaagtaaagtgttattgaatgtgtggggtttcccctcaggaatttgtctaacacatttcaaggatagaaaatacttcactgccgggcatggtggctcatgcctataatcccagtgctttgggaagccgaagcaggaggatcactggaggccaagagttggagagcagactgggcaacatagcgagacctcatctcaaaccggaattcgg

SEQ ID NO: 92028 - DNA, 1631 bp, Homo sapiens
  misc_feature (1305)..(1305): n is a, c, g, or t
ccagctacgagtggcagcaagaaggcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccacagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccagggtgatgggagctggaggtctctgaaataagggagaagggaatctgggagagctcagatggacacatggatggaaggaaagaaggatgccctgaagagaagaccttcccgggggaggtggccactgacaccccaccctatttgaacagcgaacccctccctctccacacactcccaggcaggacaaggggagccagagtcacctgcaccagccccagagcctcccagaccagaacaaggggaaggccagccatgggcagcctgcaagatttaggctagacagcaggacttacccccagagggctgtggaaaaggcccatagccgggcgtggtggctcacgcctgtaatcccagcactttgggagnctgaggcaggaggattgcttgagccccgaagttcgagaccaccgtgggcaacacagtgagaccctgtctctaaaaaaccttttttaaattaataaattaaaaagccccatggatggaggactcagtattgagcatctctttgagaggacgcgtgcacagcccccagtgtggtacctggcaccgtcagcacctcgacaggatacagtttttcccagaagaggttctccctaggcctggccacactctctccttccaaggcttggggacaccaatgagcagcaacaaatgttttcattaacattaaaagagtgtaaatgagcacatca

SEQ ID NO: 92029 - DNA, 1378 bp, Homo sapiens
ctgccattccctgcacatctcctcaatctgattagaagcaggaaggattgctggctcctctgccactggagccaccctggctcgggagctgggctcccacttgcatgcaccgacccaggcttgggatgaacgccacagcccccagctgaacccctgcaccatgggcatcctgactggtcccgaccgagagatccaaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtccccagggtcactcctctgcctgagactctctggccccagcaccatggctacaccatgtcagaacatggagctgaatcgcctagtccaggaccagatacctggccaggtggcctctgcctctgccctccaaaacctggtagagcatctccctaatgtgcccagctaccgcatcccaatcacccgcatccctgtcctcacctcccggagaaccagcttgtccaactccagcttcgccaaggagaccaggagctccatccggcaactagtgcctgccacgaaacagcacccagaagtgcaggtggaagatactgatgctgatagctgccccctcatggcagaagagaatccaccctcaaccgtgttgccgccaccgtctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgagtgagacccctctggggtctcagaaaattgaaagactgcggggagggtgggggatgtgggggggctagtgtggatgcttttagaaccttcttaccgcaaggcagactttgccagtggcttccgagcagtaagtcgggatcggtcgcctgcccaggctgcttctggctggcccaggagtcctgttaaatccagtgggctcaacctctgggcccagctgtgtccacggccagcagtgctcagagagggagggatctctaggcagaggtccccttgtgaaggagaggctgaggggagctgcctgcagggctcctgctgctgaacttctgaaaggtcagtggggacagggaggaccaccaggatctccagtgggttctgccctggggagtttgtga

SEQ ID NO: 92030 - DNA, 1942 bp, Homo sapiens
gaattccgatggcagaagagaatccacctgcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccacagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccatcagcatccttcctggaggacaagtggagcctgaccttgtcctagaggaggttgaaccgccctgggaggatgcccaccaggatgtcagtaccagcccacagggtacagaggtggttccagcttatgaagaagagaacaaagctgtggagaagatgcccagagagctgtcccggattgaagaggagaaagaagatgaggaggaggaagaggaagaggaggaggaggaggaagaggaggaggtgactgaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggaggaagaagctgccctctgaggatgatgaggctgaagagctcaaggcgttgtcaccagcagagtccccagtggttgcctggtctgaccccaccaccccgaaggacactgagtgagacccctctggggtctcagaaaattgaaagactgcggggagggtgggggatgtgggggggctagtgtggatgcttttagaaccttcttaccgcaaggcagactttgccagtggcttccgagcagtaagtcgggatcggtcgcctgcccaggctgcttctggctggcccaggagtcctgttaaatccagtgggctcaacctctgggcccagctgtgtccacggccagcagtgctcagagagggagggatctctaggcagaggtccccttgtgaaggagaggctgaggggagctgcctgcagggctcctgctgctgaacttctgaaaggtcagtggggacagggaggaccaccaggatctccagtgggttctgccctggggagtttgtga

SEQ ID NO: 92031 - DNA, 342 bp, Homo sapiens
gcaagtagggaggatatcgctaaattcttttcctagcaagcaatattaatattaataccctgggaaaggaatgcattcctggggagaggtctataaacagctgctctgggaatgtctgtcttacgtggttgagataaggactgagatacgccctgatctcctgcagtaccctcaggcttactacggtggggaaaaactccaccctggtgaatttgtggtcagacgtttccctattttttgttcaagatgtttatcaagataatacgtgcaccgctgaacatggacccttatcagtagttctgtgttgccttttctcctgttccctcagaagcaagtgatctt

SEQ ID NO: 92032 - DNA, 384 bp, Homo sapiens
agtaacatcacaaatcattcatcaccataacagataaaataataatgaaaaagtttgaaatattgcaagaattaccagattgtgacccagaagacacaaaatggacacatcctgttggacaaatagctccaaaagacttgctcagcacagggttgccacaaaccttcagtttgtaaaaaaacacaattacgtgtgaagcttgataaagtgaaatgcagtgaaatgaaggctgccggtattaggttgtttatactgagatctttctgggcagctgatggtttgattttcttttttattctgatgagtgttctgttacctagtagggtaggtcttttctctgtacacttactaaaaaccaaaaaagttcttctcccttatatttta

SEQ ID NO: 92033 - DNA, 546 bp, Homo sapiens
agaacatccagcctctccagtactgaggcctctctgggattctttatcttttgtctgaaagcattatgaggcttaattcccataaaaataaaacacattccaaagccaaggccagggtttgggcattctctgctggtttatactgaccactcccccaggtcccgttcatgagcatggagaatagagaactgatggtagggctgatattgtgcaggcatggccctttcatggaaacagagggctaaggaggccttaaaaagccttcggggccagtcctttgtctccaagaggtcttgcttagcacgaatagatcagaccactctccccctattttcctcccagacagtaagacttgctaaggtcttaggaatataaatattccacctgggccgggtgtggtggctcatgcctgtaattccagcactttgggaagttgaggtgggcggctcacgaggtcaagagatcgagaccatcttggccaacatggtgaaactccgtctctactaaaaatacaaaaattagctgggcatggtggcgcgtgcctgt

SEQ ID NO: 92034 - DNA, 364 bp, Homo sapiens
tggaaaaggagtttggctctgttgcccaggttggagtgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92035 - DNA, 3384 bp, Homo sapiens
caccttctccacaaggcagcaggagagagagagagagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92036 - DNA, 2979 bp, Homo sapiens
gctggtacgcgccggaatttagggatcgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92037 - DNA, 2611 bp, Homo sapiens
agtgttgcaagaagggcacagtggtatgtggtcccctcgaatgagacggcaagtacaatgtcatgcactgtaggtaatagatggcaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92038 - DNA, 5054 bp, Homo sapiens
gatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92039 - DNA, 4728 bp, Homo sapiens
gatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtgaaaaaaaaaaaaaaaaaaaaaaaaaaaaaaaaaaaaaaaaaaaaaaaaaggggggggggccaaaaaaatccccccggggggccccaatagcgcgcgcacccccgcgcgtttttgtggccaacacaagggggcccccactaagagagaggagagcgccgtttattattacacgacgcgcgaagagcacgagcgggccgcggcggttataaccaaggcgcgcagagcaagggggacaaacaccgctgcaaaccggggggaaaccctttgggagagaagagagaacccccttaatctcggcggggcggggagaggccccaaatatggtgtggcaaacacaccctcccctctaacaggcagagtatttatgaagggcgctctctagagaggggcagcaatatattaaaaagattgttgaagagggggtgtacataaagggggtcgttgtaacaaccacatagcacggagataatattgtcgcttgggcgtggtgtagcaaaaatttttgttggcactatagaggggagtatattattatttgtgtggaaaaattttttacaaccgggggg

SEQ ID NO: 92040 - DNA, 3958 bp, Homo sapiens
gatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacgtaagtagcttctcccagagatctcaacataggtttttggtatttctagtttccaagtaagacatcctatttctccacacattgatctggcttaatgtctgcctgataatacagccttgcagataagtgagaactta

SEQ ID NO: 92041 - DNA, 314 bp, Homo sapiens
ctctccacctcaacctccagcccacctccaggctggggaaggggctgagtcttcccctcccatacatacctcacccggcccccagcccacagagaggctgagggaggggctctgggtcctcctccatccctgtacctgcttcttccctcttcatttccaccttctagatctttccccccacccagcccacctccaggctggggaaggtgaggaattctttcctcccacaccctaccccacctcacctgcagcctgtgccctgggccaggagaggcatgggtgaacacccagacccacaacccccgaccctgcag

SEQ ID NO: 92042 - DNA, 6289 bp, Homo sapiens
gatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92043 - DNA, 6106 bp, Homo sapiens
gatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92044 - DNA, 2935 bp, Homo sapiens
cacgcgtcgggaaaagtccagctcggccacgcgtccgcacacgcttcattaactatgctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92045 - DNA, 6258 bp, Homo sapiens
gatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 92046 - DNA, 4381 bp, Homo sapiens
gatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctgtacaattaaaattaagtttgacattaaatctaaaacaaaattctttgaaaataaaaaggctggacatggtggctcacatctgtaataccagcacgtgggccagtctgagatgggagggtcatcag

SEQ ID NO: 92047 - DNA, 1461 bp, Homo sapiens
gattatttcttttttcatcttttcaatcctgcttacttttatcctcacttttctttctgccatgaaaactgcacctaatttaccacacttaagattggcaatttttgattcattgatgggagaagtacagtagaaaggccctgcagtttagaattaagttgtgtttgtttatttacatgtatgcccatttcttctaaattaaatctagaatgtgagactttgacatataaaagcatgataagtattttcttaaaaaataagactattgatacataatgaaaccaccattggtaattgaattttaaaatgatatgcaaaaatatttagaaatccagttgggaaatgtgtttttgcatatgtcaccagatacacattaggcagtactacaaatgttaattcttaaacaatactgtggtgatggcaatcagtaatttatttctttgtcctgtaacttatcattcttgtcttttgtaatgtcttacacagtattaacataactgtaccttttttttgttcttggtatccatacattttaagatggaaaatcagttcatagttgatatgatattgtatatgggcaaaatgtccgttaaactaaaattcagtaaaaaaggtaatataaactggcttgatttataaaagatgttttgtttggcagttatcagtcattataagcaattatcttcaaagacaaaaaaactggactaatttgttgccattctttatgggatgtttacaataaaattccaagttgtttggaatcaattgcactcttgctgctttatgccttaatttatgtaccagagaaaaattaaccagaagaaagaaatatggagttacctattcagctttagagattgtaacatgtaactcttaggtctttcttgtttctttgtcatagaatattttattactattactttttaatctgagaaactaggatgcttcttcctatcaaagaaaaggttttgttttttgttttcatcttagacattgcaaatattctttgggtcacttttaggataataaatatgatgtttacactttaaatgtgggctgcttggtgcattcaataacagcctgcaaagcatttgtcaacattttgttttgcagagcttttcaaaatgaatagatctctaacatatttatgacttacaacttttaacagctgagttatatgtacctgacattttaaaatgtatagtaagattacctacattgtaaatggtgctttaattcagtgtaagtgtaggagagagagaagtgaggtgagatgatctgaatgctctaacaggaacattcataactatatagttacccagaatttgtctcccagtggcaaacattccactaggttcaagataaataagctggccaaagactggactgtatctttgatatatatatactgtgtattttgtgtatttagaataaaaaaaatgcatttaggaaaaaagtaga

SEQ ID NO: 92048 - DNA, 1429 bp, Homo sapiens
cccgcgtggcgctgagccaatgagagttgacgccggcctggagggcggggacacaccgtgcaggccccgcctctttcctcccttttctcagaaacccgacggcgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagca

SEQ ID NO: 92049 - DNA, 1010 bp, Homo sapiens
aggtggaatgaagagtgagaaagctgtctaggtgcctgtccaattagggcagtaggaagaatcctgatggccaggcagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagca

SEQ ID NO: 92050 - DNA, 1411 bp, Homo sapiens
cccgcgtggcgctgagccaatgagagttgacgccggcctggagggcggggacacaccgtgcaggccccgcctctttcctcccttttctcagaaacccgacggcgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagca

SEQ ID NO: 92051 - DNA, 1056 bp, Homo sapiens
tggatcctgaggtgtcttagcggcctctagaccccaatccagccaacagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggggatccccaggcctcagttcccaaaccttacctgaatatccaagaccctagctcacagggttcccctttgccaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagca

SEQ ID NO: 92052 - DNA, 1057 bp, Homo sapiens
agagagggaggagggaggccgcatagaagagagggaggaattactgaacaggagagggggattggaagacctagggaggtccccttcattctgagaaaagaaggggtctcttgaagactaaaaagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagca

SEQ ID NO: 92053 - DNA, 1647 bp, Homo sapiens
cccgcgtggcgctgagccaatgagagttgacgccggcctggagggcggggacacaccgtgcaggccccgcctctttcctcccttttctcagaaacccgacggcgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctaggtgagggtttgaatcctcttttcccaagattcaggctggggatggagcctgagtctgggcccattctcggctttatctaaactccagattaccaagcctggggctgagccccaaggaggctcagaagggccagaccccaggcagggccttggggcacagatatcatcaccttcccctctgggatgtttgggaccggacctccgtattaaccctgaacttccgtactaacccctcagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagca

SEQ ID NO: 92054 - DNA, 435 bp, Homo sapiens
gtctctgcaggtgaggactccatcagcaccttgggcctgatccttggcgtggggctcttgctgctgctcgtgtccatcctcggctacagcctggccaagtggtaccagcgcgggtactgctgggaggggcctaattttgtcttcaacttatatcaaatccggaacctgaaggatctggagatgggtccacccttcaccatcagtggtcacatcagcagcacagatggtggctacatgaagttctccaacgggctagtctgatgcagagacagcaacttgtgaagccctggggagaacttccttgacctccaaatcaccaaattctgcccattcttcatgccagctcaaatttcccttctccagggagacttctgtaagacccatggatcttgtgctctgctgattttaaatacagatagtctcaggcccccataa

SEQ ID NO: 92055 - DNA, 305 bp, Homo sapiens
tgcagttttaccaaaagaaaaatctgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttt

SEQ ID NO: 92056 - DNA, 263 bp, Homo sapiens
aaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttcca

SEQ ID NO: 92057 - DNA, 919 bp, Homo sapiens
atctcattaggataaaattctgtgggggagttggaatggaaatacaagattgaaagaaagtaatatctctgactgctgaagaggttatttctatttttaaatagattatgatagaattcaaattgttgtagtatctccagtcaaaggaacttaggcttcttgagaaagtggttgattgcaggtctaaggcaggaaaatacaagatgaaactggaatatcttgtgatggcagaaaataaggaggtgctcacaaaaagatggcacatgtctgaaggctacaggaaccaacctgaaggagctctccagtggaaatgctggaacaatttgagcaaacaataaaaaattataatattggattataacccacacaataaatatctgtgtgtccatactgatgtaaacaattgaatgagtgaatgaatgaatgaaaagaagaaacagttcttctccccagtaaattccaattgataaatgtagaagaaatgggagaaacaaaaatcactatcaggaaaacacaacagtaataattgttggcaagacctaccagttggtgcaaaagttagtgggtgaatgtttgaggaaaaacagaatatttgcataaccttagagtattttccccaaaataatcactaattacaaagagaaagtaataactttacagtagagaaacttctttaatcaagggatcaaggttaacagaagcagtaataagccacatcagcatcatgtaccccctggtatggcattgagaagggcacatgacttctttggtatcctccccaaaatgcataatctcaatcatgaaaaaacattagacaaatccaagttgagggacattccacaagataaatgatcacttcaaaagtgtcctggtcatgaaagataaggaaagattgaggaaatgtcaaggattggaggac

SEQ ID NO: 92058 - DNA, 558 bp, Homo sapiens
ggggaaatggaaaacagctgaccactgattccttgaaatcacctactcagacactccagggtctgtgtgggattaagtcgtccgcagtctttccctcccttaatctcttctaaccttcctcgaaagtgccgtttcccaccccattttaatcatgccctttgctctcgcctggacatctccaggggctccagtgcctctctaagtgaagggtttggggccacacacatggctgtctgttctctccaggcccacatgcagaatccagcagccccctggcctcacacctgcttttcagtagtggctgggactgccagatgaataggcttgaggcagcatacgagtttgctatacacttgctcaaaacattagtggactcaaaaccaaaaagacaacccagtttcagaatgggcagaagacttgaacacacatttttccagagaagttatataaatggccaataaacacatgaaaagaggctcagtacccatggttgttagggaaatgcaaattaaacccatgaaatcccccttcacacaaaataggagggctgtaataaaa

SEQ ID NO: 92059 - DNA, 496 bp, Homo sapiens
atatgccccaaacatcagatttataatagaaaaaaaattgggtttaaacaatttgtctttattcccaggcagttcggtatagtaaattaggggtatttggtttctgttcattcaaaatcttggtactcaaactggtgtcttcagaagctgttcctctattgaagcgtttgttgataaaataggcaaaggttcacatgtaagtgttgcaagttttcttctccttgtctgatgacaaattaggaactcacctactgcgttttgaatagtagttgtctggaacacataaaggatcactgccaagttttttgagtttccaggatctaagtttaagccaagatttttgtttcccagaagtttatgaattcatttgaaattagatttttctcttattatgtggccggcagtgcttgcaagcacaacgccaaatcgactggacgtggaaagtgaaatactacagaagtcacaatctattaaataaaatgttaacataataaaa

SEQ ID NO: 92060 - DNA, 514 bp, Homo sapiens
actatttttatgctgtggctgtgctgtgcaggagctgggcttttcgtgcattttagacagaattgaccttggttaatgcttgacttgggaactatgcagaaacatccaggaagtggtggtggctgatcctgaccgtcctcagttttgtgaagcaacagcctctgtgcctctttctctgcatgctctgttgacggtctagtcttgagagagaacctgctgctgtcccgtctgtcatagccttcctagcaactcttaggcctgcgtgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaa

SEQ ID NO: 92061 - DNA, 215 bp, Homo sapiens
aacccagatcaacaaatcagaatctctagggaaacccagactttggtatttttatgaggtccacaggtgagcatagacctgcagccagggttgagaacccccactgcagggaaagggagatagatcctccccccagtgccctcaggggcctcagagctggcgaagggaaaggcagtagtagtcatgattagcatttactgagtactgttccactg

SEQ ID NO: 92062 - DNA, 795 bp, Homo sapiens
gtgacatagtgctaccttttttttaaaacctgtcttgcccaggcattattgagtgccccctggtgccagcatgtgtatttcacgactgtatcaacaaatcatgatcatcttctctggccattgtgccctttcagattccaaacttgttacctctcagtccttcctacaaacttagaaagtctaatatcttaatgtttacttatgtagcaagcctccctttctcccatccctaaatcctcttgtaattaattattttcctttggaactttttaaatctacaatttccttataatatggtaaccaatattaattttcttgttctgcgccaagtttgattttatacaaattgtttccagtttgggtcatgagcacaaaaccaggtatttttaaaaatctatataacccttcaatgaggcagtattaattttattaactcattaattcaaccaataattcttgattgtttactgtgttagatattggggtatccccaatacctgacagctgtgagcaaaacaaatgccctacacacatgaggtgtacagtccagtagaaaagataaacaataagcaaattaatagataatatgatgtccaataaggacttcaaaggaaaataaagcagagtaaagagccagagaatgacagtgagctgtttttcacatgagtcatcagaaaaggcctctttaaagaattgacatttgaacagaaaaacgaatcaagggcgtcaactgtttattgcttttattgcttaccatttgaccaagcaattctacacataggattcaccctaaaa

SEQ ID NO: 92063 - DNA, 418 bp, Homo sapiens
gcgagagaaaaccacgtgcaccaaactttaggggaggaaaaatgggaacgtggggagaagacgtgaggcggcagatctgaaaaagatggtcattccggactcctgacgccgccagtcccgcggtgagacgtgagcgccattggcgtccgtggcctctgtttccgtggcaacctagtaaccattaattttcaattaaaggagacaaaaagctcgatgacagctccaggtctgctgaagatgtcaagaatctgtattaatatacagcaagagagcataattgtgtgtccatcttccagagcagcgaaaaatggagggataattaccagctcgaaagccactctgtaatttagttcttactgtcaccacagccctacacattagcataaattaaaagcagagtttattgttatcaaagtgc

SEQ ID NO: 92064 - DNA, 407 bp, Homo sapiens
accccagggattcaccctggcctcggactaatcctatggggcgcttgcaaaccccggccatcccctggagtctgaaggtcattccggactcctgacgccgccagtcccgcggtgagacgtgagcgccattggcgtccgtggcctctgtttccgtggcaacctagtaaccattaattttcaattaaaggagacaaaaagctcgatgacagctccaggtctgctgaagatgtcaagaatctgtattaatatacagcaagagagcataattgtgtgtccatcttccagagcagcgaaaaatggagggataattaccagctcgaaagccactctgtaatttagttcttactgtcaccacagccctacacattagcataaattaaaagcagagtttattgttatcaaagtgc

SEQ ID NO: 92065 - DNA, 574 bp, Homo sapiens
ccctggttttctgtggaaagtgagcttctgggttcgacagtgggaccggcacagaccttcccgcagctacaggccatacgacaaccccgctgctctttctttctgcgggcactcgggccagtcctaacaattgcccctcaagctgtgtgtgctgccctaaccctcaatcccgaacccgaaacagtgcgtgctgggacgaatctaggcaggtctccgaaaccggggtgaagatgctgaagttcaggtcattccggactcctgacgccgccagtcccgcggtgagacgtgagcgccattggcgtccgtggcctctgtttccgtggcaacctagtaaccattaattttcaattaaaggagacaaaaagctcgatgacagctccaggtctgctgaagatgtcaagaatctgtattaatatacagcaagagagcataattgtgtgtccatcttccagagcagcgaaaaatggagggataattaccagctcgaaagccactctgtaatttagttcttactgtcaccacagccctacacattagcataaattaaaagcagagtttattgttatcaaagtgc

SEQ ID NO: 92066 - DNA, 684 bp, Homo sapiens
catgtacagaaccaaagagcaaaagctgaaatcagtgggagctgggtggggttctgccaccagagagcatgaaaaagacgatgagaatgatgatggaaaacaaaggcttaatttacattttccattctaaaacataatgctcaatggggatttactttcttgctaaggggtaatgaatagtcaatttcagactaaagattttctgcattcatcttccccaagtgtttcatatctttacattacatttttcagatatagatattttcatcactaatattgttcctctcaatttcccctttctcattttttgtaaaatggcaaaatgaacaaaatattcaaatatttgtgtcaatttacaatagactaaaattaaaatgctggctaccaaacagtattaccaaaacaacagtttacaataatcatttcccaggtgaggcgttaagagtccaggtgaggtgcttacagatgcttggttaaagctcaaggacagtggctacatgaaggggagacagctccctgcaggaaagagactgcagacagggaccgggaaaggtcacgtgtgacctaagaggagaaaaggacattccttcctaggactgaatgaacaggaaacaaattcagtaccccgaaagtctacacaaatctgaactttgcatatatcaatgacaaaaattcacttaactg

SEQ ID NO: 92067 - DNA, 101 bp, Homo sapiens
tgggagaattctgtggcaaaagaaaagtttcaatcctgagatctctgaagggacatctttctttgccctcacttatccctctgctctttccttatttactt

SEQ ID NO: 92068 - DNA, 174 bp, Homo sapiens
ttctaatgttaaactactcaacaataaagttacatagcatcctgttcacttgttctgggcctaatctattgcttgagattctaaattttttagctgacttttaaattattttcttagttgttttgtacaccttctcctctttttgctatgactaaaatcatctgaagcctcttg

SEQ ID NO: 92069 - DNA, 379 bp, Homo sapiens
ccgggatacacacagtcccaccgtttgaatagcagaattgcgagtcttaatttggaaagggcaaggctgctgcctctttaacagtggaagaagacaaaatggaaacaaagtagttacggtttaagttttacctgaccaagcaaacaaagatttacttttagatctgcaaagttaatggaaataattatttacacactttagaagcgtctgtttatgatgtggagcttaggcatatatcctagtactcagaaataatctgttcttgagaacctacagactgtggcaggagaagcaaactgctcatctaagatctagaatctcagtgtttattgtgaaccaaccccagagacttgaactgtgtccagagagaactgcattt

SEQ ID NO: 92070 - DNA, 294 bp, Homo sapiens
aaatgggaatagggcagggtacataggggatgccagctgtatttgtttttatttaaagcaaaaatggcagaatgttaggatctgattgttgggtggtggatacacgtatatttttgtgctgttttctgtattttgcagtattttatttttgaaaattaccaaaacaggccgaacacagtggctcatggctttaaccctggcactttgggagggcgaggcaggcagatcacttgaggccaggagtttgagactagcctggccaacaaagtaaaaacccatttctactagaaatac

SEQ ID NO: 92071 - DNA, 237 bp, Homo sapiens
ttaaccactgcactcagtgctctgttattgaggactgacataggaatacttatgtgctctttggttaacacagcacagactttgtttcatgtattatgtggagggttagaggtgagaacctgattgtgttaacatgctagcgagtcattcagaagatatttagtggttggataataacggggcatcgttaaatgtcaggctgaggtgttgggactctctaagcattggggagcccca

SEQ ID NO: 92072 - DNA, 289 bp, Homo sapiens
gtagaatcagaaattgaaattccctcttcgccttgtttgagttgcatccttatttaaaatattgtagggtgatctgagtcctgaaatagcttattggagacattgaatgcaattctgtagtataaatgtctatcctacgtcttctttttgtatgggatctttgagaagggaacttatactttgtttgaatgaagtcaccagaacagcattgtccattagaactttctgcacaaatggaaatgtgccgtatctgtattgtccaagggcactagctacatgtagctgttga

SEQ ID NO: 92073 - DNA, 872 bp, Homo sapiens
agcgggcacttcctgcgacgcccctgcagcagcagcagcgtggtcagagcgagcttctgagcggtggtgggttccatgtgatggtggagtaggagacaggtctccgcggtcagtggcgggggcgtggaccccaccgggaaccctccctgctccttccctgcctctccctgttttcgtgcccgcacttcttcgtgggcatctgggcccgagtcctccgcttgggggcggttgtgcggtcctggctactgcagcgtccgcaccccggccgggaaggctatgccaatgtccgacccgcgtccagcgtataggagcgccctggcccacagctggcggtaaaacgcgggacctgggtccctcggagccccaggggcctctgagctggagtctaggattatttttgatgcctcagcacctttaaaaagagacctcgctagagcagggggcatctgtattttcagttctttgaggagtctccagctatttagctgttttccatggttcatctgcgttgctctaaatgggactgtttcattattttgatggctgaagaatatttcctagtgtatgtatatgagagtttcttgatctctttatctgtggatgaacagctactttgaaatatatgatacatttgtgttaaggctagtcacgctgctgtggaatagaaggtcagaattgatcactatcatctgagagtaactttgtacccatcactgattccttccgagactgcctccacttccccagcagcctctgatttcttcatgtggctgcagatggcaggatttcccaaaggtttaatggctgcaacatattccgtggtgtatctgtacagcagtttcctcattcctgcagctgtgtttgaacaggta

SEQ ID NO: 92074 - DNA, 441 bp, Homo sapiens
agcgggcacttcctgcgacgcccctgcagcagcagcagcgtggtcagagcgagcttctgagcggtggttcatctgcgttgctctaaatgggactgtttcattattttgatggctgaagaatatttcctagtgtatgtatatgagagtttcttgatctctttatctgtggatgaacagctactttgaaatatatgatacatttgtgttaaggctagtcacgctgctgtggaatagaaggtcagaattgatcactatcatctgagagtaactttgtacccatcactgattccttccgagactgcctccacttccccagcagcctctgatttcttcatgtggctgcagatggcaggatttcccaaaggtttaatggctgcaacatattccgtggtgtatctgtacagcagtttcctcattcctgcagctgtgtttgaacaggta

SEQ ID NO: 92075 - DNA, 397 bp, Homo sapiens
agctcgctggtgctctctgcaaacttgcagtgcaagtctatgatataagtggtgtagagtggttttgttgctaagagaaaagtgctaaaaaggaaaaaaaaaaaaaaggagggcctatatctcttgtgtagctcagatcctttgggtatttaatgtacagtttcagcaaaagacactcagaattatacctctggttggttcaaaattgcttaaatgttgaaacatatggtctcatgttccatttgttagcaaacaaccagctgttctcagcctgccaaatccaagtaaacatccactgtgtggaagagtgaatctgaaatggttcagtaaaaacataaaagctgtttttgctgaagaagaagaaaaaaaaaaggccaccccgaaacaacagctagtg

SEQ ID NO: 92076 - DNA, 325 bp, Homo sapiens
ccgcccgctccagtccccgccactcctgactctgagggcctggggactcctcctcccccgacatcacaaatcgtcccaaccctggtcagtcaagcggaagcggcgacctagttcctccttccagtctcagcccagggagctgcctccagcttcacccactgggggtggatggcacaggacacctgtgggacagcccaggaccctgagcaatctgcttgccccagagatttctgcgggtgggtagaggggggtgtgcacagctgtgcctatgtgagagatccaccccacaggagttgtgtcagggcaggatgtgcaggaggggtac

SEQ ID NO: 92077 - DNA, 469 bp, Homo sapiens
ctcttaaacccgggaggcagaggttgcagtgagccaagaccattgcactccagcctgggcaacaagagcgagactccgtctcaaaaaaatacaaaaaatcatctgggcttggtggtgaacgcctgtaatcccagttactcaggaggctaaaccacaagaatcacttgaacctgggaggcagaggttgcagtgagcaaactccactccacgtcactgcactccagcctgggtaacagagcgaggctctgtctcaaaaacaacaactacaacaaaaaagataggacagtagattttattagaccctgaagcatactggaggctttttcatttctgcattccctgacagtgctccatagagtaggtcttcaaaggtagatagtaatctcattaccctggactgttctcataatgtaacagatcactaacactgaatcttaaaaataaagttcttttagtaattttaaaaaaa

SEQ ID NO: 92078 - DNA, 687 bp, Homo sapiens
agctaggaacatgtagcttgaccttaatgttgagtgccagatagagactgtggtgtgaactgtttcctaaagaaatctaaggctaagaaagattatgattgtagtgtcttactgtgtgtgttcaaccttgtgcttagagtatcagaaatatctctcttcaaatccagagctctatactatgcatcttttattcttggtagtttttgggatccccggatgctttttccttgggtgactgatgcatttcaattcccacctagctctttgacaggacacttttacttaaatggaaaatctagtgttttgcttagtaatgttttgtgctatgggattgaaagttgtatttggaaggtctgcatagggattttctttctagaaaggttattttctgttgtcatcttactttggaatagatttttaaaaatatgaaaataagcactagattttcatatctttaaaagtcacttacgtgtttttacttcttaaaaatttccctttaaaatctctattttatacaaaaattatctgggtgtgttggcgagcgcctgtaattccagctacttgggaggctgagtcaggagacttgcttgaatctgggaggtggaggttgcagtgagctgagatcataccactgcactccagctgtcactcttggatgacagagtgagactctgtctcaaaaaaaaa

SEQ ID NO: 92079 - DNA, 425 bp, Homo sapiens
agctaggaacatgtagcttgaccttaatgttgagtgccagatagagactgtggtgtgaactgtttcctaaagaaatctaaggctaagaaagattatgattgtagtgtcttactgtgtgtgttcaaccttgtgcttagagtatcagaaatatctctcttcaaatccagagctctatactatgcatcttttattcttggtagtttttgggatccccggatgctttttccttgggtgactgatgcatttcaattcccacctagctctttgacaggacacttttacttaaatggaaaatctagtgttttgcttagtaatgttttgtgctatgggattgaaagttgtatttggaaggtctgcatagggattttctttctagaaaggttattttctgttgtcatcagacaatgtatgggtaccgagctcgg

SEQ ID NO: 92080 - DNA, 431 bp, Homo sapiens
gtaatgagtgagaaagtttgattctgttttacatcaaggcctggaacaaagagtcacaggacaaagctataagtaagaggcaggccctgggaagcctcctttaacctccatagagaagtctctcttgatcctctagataagcttggcctttgttgaaacaaagatcacactgaatttgtctatatgaagatggcagaaaactgtgaggttcttcagggaaagaatacattatttatctatattccaatattcagtacacattcagtatttacagaatgaagttcaatcagaataaatgttcaaacaaacagacccctacagtagtggaaacagcacaaatgtccattgtttagggaattcatccagtgaggccagggctggaggagatgaccttctaatagttgttctaattctgcttctagccttctgca

SEQ ID NO: 92081 - DNA, 475 bp, Homo sapiens
agcatgcttaattcgtttcatttttcttctatttttgacactaaaagcatttaatgctgtttttacctctgcatatagctttggctgttaatcctactttttaaattattttctaaatcgtctgttttttaatttttttaactcttgatttacatcttgtcctaaggataatttgaggtgctacttacgtttcaaaatttctaagtggtatgttttacattattgttagttgtattgcattttgatctgagaatggtttctagaatttctacttttcaaaatttaccaaaatattctttgtagcttaataattatttaattttgtccactgtccatgaaacttgaaaagaaggtgtactgtttgttttcagggtaagaaatttatatgttcatattttctatgtccttatttattttttgattatttgttcagaaaatgtgttagaatatttccaataaaactgtttctcatgtt

SEQ ID NO: 92082 - DNA, 697 bp, Homo sapiens
gtgaagcgctgtgtgcagcagctgggcctggcgctggacttcatgcacgggcggcagctggtgcaccgcgacatcaagcccgagaacgtgctgctgttcgaccgcgagtgccgccgcgtaaagctggccgacttcggcatgacgcgccgcgtgggctgccgcgtcaagcgcgtgagcggcaccatcccttacacggcgcctgaggtgtgccaggcgggccgcgccgacgggctggcggtggacacgggcgtggacgtgtgggccttcggcgtgctcatcttctgcgtgctcaccggcaacttcccgtgggaggcggcgtcgggcgccgacgccttcttcgaggagttcgtgcgctggcagccggggccgcctgccggggctgccttcgcagtggcgccgcttcaccgagcccgcgctgcgcatgttccagcgcttactggccctggagcccgagcgccgcggcccagccaaggaggtgttccgcttcctcaagcacgagctcacgtccgagctgcgccgccggccctcgcaccgcgcgcgcaagccccccggggaccgcccgcccgccgccgggccactgcgcctcgaggcgcctgggccgctcaagcggacggtgctgaccgagcgcggcagcggctcccggcccgcgccccccgcggacgggtcggcgcccaagcccgagccggtgccggcgcca

SEQ ID NO: 92083 - DNA, 366 bp, Homo sapiens
cccaagggcttcagccagctccaatgcccaagggcccatggcatgtttgatttgccagcacatgatcccacaaaacattgcatcagaccaagtgtccgaccttgcaacagaggtggcacagcatgggatcatgaaatccgtggccatccttttgggtcctaccaccatccagaaagctgctggcctgataaaaccatggaactgtctttgaaagatgtagctgaggctgggcacagtggctcacacctgtaatgccagcactttgggaggtggaggtgggcagatcactcgtggtcaggagttcaagaccagcctggccaacatggtgaaactccatctctactaaaaaatacaaaatacatggtg

SEQ ID NO: 92084 - DNA, 243 bp, Homo sapiens
ggtttatgtaagattttaaggggaaatgtgaattaccctcagtagtacgaactgacccttggtgaaatggccatgtgccttctttcctacctatctcctaatattttcccatgaacaccctacattccagctctaaggaactacctggttctcctggaggaggccgtgttgttttaggtttggggggttttgcatgctttcttcttaatctggattgcccctgccctagctaactcccatcca

SEQ ID NO: 92085 - DNA, 298 bp, Homo sapiens
atgaggctgggctgcgggccctcgcacctcccaccacccgcctgcccctccagactccgccttttgaggcccctcaccctgaggccatgtcaggcacagaccctctgggctcaccactacacttgagcctcccatcccctgaactgtgcgcccatcccctggacggcagccatcatctgaactgtgcacccatgccctgaactgtgcacccatacgctgaactgcacccatacgctgagccgcatccatcccttggactgcagccatcatctgaactacacccatcccctgcactgca

SEQ ID NO: 92086 - DNA, 379 bp, Homo sapiens
gtagctcctgtctcctggtggacgtccttcacagaattgtcttcttggtcctctagagagctttgtgggtggaaagtggcattttcctccttacaggaagagaaattgagagaagggggttatttcacttgatgagatcacactttggtgctcagcctgcactgagcctaggagtgtgaattcctaagttcacataggcattctagagagaccacagcatcacatagtcattctagctagcgaccgcagcatcacacagacactctagagagaccacagcatcacaagacacgctagagagaccacagtgtcacacaggcattctagagagaccacagcgtcacacaggcattctagagagaccacagtgtcacacaga

SEQ ID NO: 92087 - DNA, 196 bp, Homo sapiens
gtgtagtgagatccccggtgacatgaagggccctcttgaagattgtgatcatgaattgaaagtgagattagttggtgtgattgtgtctttttctccagcgattttgagctgcatagttgtagaggcagaagaggtgaatttaaccagaggtccaaacttccggagaacacgcagctgaagaggtccaatcttccgg

SEQ ID NO: 92088 - DNA, 128 bp, Homo sapiens
gagtcctgtgccccgggccggtgggatgttgacagctcctttggttgtcgaggcggctgggctgagcacatggcggcattgggagggcctgcaggaagactcatttcctgactgactgacaaacagag

SEQ ID NO: 92089 - DNA, 425 bp, Homo sapiens
ggattttaggcagattagactaggggatcctttatttgttgttcctaatcatgagatatgccacatctacaaagttttacaaagaaatgaaaatttaaataaattttactttgactatctggttagcatgaattacaagctaaaacatccagtgataagactacttaataaatgtattcttttaattgtagataggagcaaaagtacatgctggggtggactagcaagtgatatggcagattaacattctaaaagggtcaatgctttttcccagaaagcatgcttttgttgtacactcctgtggtgccactaaatttttggaaattaattcagaaagttgaaatagaattgtcagatttcagtcttgtttttttcatttttttaatttctttcttgttcttgtctgctttatgccctctctaatg

SEQ ID NO: 92090 - DNA, 474 bp, Homo sapiens
tacaataaaacatgtttatgataaagtattaaatgttctcagaaattaaggttttaggccggccatggtggctcacacccgtaatcccagcatttggcaggccaaggcaggtaaatcacttgagatcaggagttcatgaccagcctggccaacatggtgaaaccccatctctactaaaaatatgaaaaattagccgggtgtgctggtgcatgcctgtaatcccagtcactcgggaggctgaagcagaagactagcatgaacccaggaggcagaggtttcagtgagccgagattatgtcactgtgctccagcctgggtaaacagaacgagactccatctcaaaaaaaaaaaaaaaaaaattaaggttttcagtggaaaagaggaaaaaaaatcaaagaaattttgaaaaacaacttaaattggaaatctatgaactttatttttgaatatatttgcttactctgttttttaaagg

SEQ ID NO: 92091 - DNA, 667 bp, Homo sapiens
gcattgggtactctgccatttgtcttcagtttttagaattagaaggagattgcaattcatgctataggcaaacagtgatttctgccgcacttttgaaagactgattgcatgaggcattgtacttttattatattttctatatcgacagtttacattttgtgcctaacagtaacatttgttgaatgtttacttatgtgtcaggcacaattctaatacttgacatgaatcagaccatttaatcttcataacagctcttatgaggtagtttcaattattatttccatttttctgatgtggaaactaaagtaccgggaggttaaataattaggtcagtgttgtaagtttcatagtgaaggatctggccgggtgtgatggctcatgcctgtaatcccagcactttgggaggccaagacgggcagatcacttgaagtcaggagaccagcctggccaacatggcaaaacctcctctctactaaaaatacaaaaaaactagatgggtgtggtggctggagcctgtaattctagctactcaggaggctgaagcaggagaatcgctgaaacccaggaggctgagattgcagtgagccaagattgcgccactgcactgcagcctgggaaaaaaaaaaaaaattcgtagtgaaggatctgaatgacttccagagatctg

SEQ ID NO: 92092 - DNA, 509 bp, Homo sapiens
gttaggagtgccccgggtcaccacgagcagccctcggagggaggggctgtgcttcccaggtggggctctgagccagccccaggagcccctggtcacggcactgactctgttcccccacttgggatctgccctgggtggtctgcattcctgccacgcccccaggtggccctggagcagcacagaagcctgctttggagacacacgtggtccggacctgtcagagctggggagctgccacctccgggctgtgctcagtgagtcaggtggtacggccgccttcacccacggcagggtgtaactgcgaatgcccttctgggcagtggcagacagaaggaaggtgccctgaaaagctccctgccttggatccagtgagcccacgtggggcagtttattgcaagggagggaaagagagggaggcctgcacgaaggcccgtgtaggacagacacacatcgattcaggagactgaaacaccacagagccaataactagcggccggttaaaccaatca

SEQ ID NO: 92093 - DNA, 419 bp, Homo sapiens
gagaaacggcccccatgattcaattatctccaccaggttcctcccacatgtggggattatggaaactacaattcaagatgagatttgggtagggacacaaagcctaaccatatcacttgtttaagtttatccagcccaatttttactttgacaaccatcagacatcagaagtcacctttcaaaaaaaatgtgacatgcatttcaacaataatttaaaaattctcaggatgacctttgtctttaggctaccacatgcttatggtaccaaacttgttaatctcatcggatttacaacatggtatctacattaaggatgttggccaacattcctggctgctattagaatgatatgtccagataaccccatctttagaaatcatatgtaagtaccttttcagttatggaaccaaacttgcctt

SEQ ID NO: 92094 - DNA, 430 bp, Homo sapiens
cagggacagtggctcatgcctgcaatcccagcactttgggaggccgaggtgggcagatcatctgaggccaggagtttaagaccagcctggccaatgtggtgaaaccccatctctactaaaaaaaatacaaaaattagctgggtgtgttggcacgtgcctgtaatttcagctactcgggaggctgaggcaggagcatcccttgaacccctggaaggcagaggttgcagtgagctgagattgctgccattgcattccagcttgggcaacaagagtgaaactctgtctcaaaaaaaaacaaacaaacaaacaaaaaaaacccactttagtgcattttaaaggatgtccttttgttttagtatttttccagtttggacaaagctgtcccacagtgaccaataatcaggaagtttgcttattggcttgaccgtct

SEQ ID NO: 92095 - DNA, 441 bp, Homo sapiens
ctttttagtttcctttaaaacagaacagttcctcagccttttgtatgtgtcgtaacaatgtcacttttcaaaagttaagtctagctgtttgcggaacgaccctcaacttgaatttgattattttttcatgattagattcaggttagacagttttgtcagcaatactacataaacaatgtatcttttttagtgcatcacaccatgagtcaataaataatgcaaaatatttagaagaattggactctgaagaaattatagaaataactttttcttattttcttttcatatatgcacaagagtgatatataataaatctgaatgagctataaatagttttaaaaatatgcataatattccgggcgtgagcaccgcgcccggccgcaagtttttttttccaacaacctcaccatcacttatgttttgtcttttggtaatagccat

SEQ ID NO: 92096 - DNA, 454 bp, Homo sapiens
tcagagaagcaatagatgaccatgggaatgttaacactgttgttggagagactctagatatgcagccaaaggaacttttggagatatttcacaacatcaaaagttcagaggacaaagtactgaaagtgtgtcaagtagacagtattatgacaatttgccaaggcaagaaatgaagctcatttggtattctaagctgtaccacggggaggaggcaagcaccgtttaaactactcataatgagttttcacaagaaaataaaacatttaaattctcagtgtttctaatgttttgaattacaggatacaaaatcctatattagctttactatttttttcatttccttttacctttataagagacagtaaaggaaattcttaatgttttgacaataaatttaaaggtcatgggaacaaccataatttttcctattaatcatcaagatcctgcacaattt

SEQ ID NO: 92097 - DNA, 412 bp, Homo sapiens
tagttatgtgccagacactgtgctaaacacttagatggaatattttattccatattagctctatgaggtagggacaattattatccccatttacagatgacaaaattgaaagttaggggagtcatgtagcttacctaatgttacagaggtaaagtggctgagatgaattctgatccctggaatgggcatcatttagaggggtggttcccaaaagccagtccacagactgtcttgttctctaatatataaaaaataattcagcaacatctaggagcataaatccagagattctgaatcagtagttcttggatggggcccagaaatctgaatttttttttccttttcaatgattacattttagtttactgtacaatgaaacagagaaaactacttttttttttttttttttttt

SEQ ID NO: 92098 - DNA, 1102 bp, Homo sapiens
  misc_feature (417)..(417): n is a, c, g, or t
tgtgatgtttcttttttagcctgttgatgtggtgaattgtactgattgatatttgaatattaaactggctttgcatccctagaatatacctcaccaggtcactgtgtactaggttggtgcaaaagtgcttgccattttggaccatgaattttgaatcattaaaactaggctcaaacacatctgtattaatcaaagtaagaaccattacaatcaacacaattttgccaacaagaaataagtttgtttactcctgtagcataaaaatccgtgctttgagattcgaggaacttttggaaagcactttctgcatcctgctggttgtggaagcgttttccctgcaaaaagttgtcaagatgcttgaagaagtggtagtcggttggtgagaggtcaggtgaatatggtggataaggcaaaacntcatagcccaattagttcaacttttgaagcgttggttgtgcaacatgcagtcaggcattattgtggagaataactcggccctttctgttgactaatgccagctgcagggattacagttttcagtgcatcctatcgatttgctgagcaaacttctcagctataatggtttcaccaggaatcagaaagctgtagtggatcagaccggcagcagaccaccaaacagtgaccatgacctattttgggtgcaagtttggcttggggaattgctttggagcttcttctcagtccaaccctgagctggtcatcacaggttgttgtataaaatccacttttcgtcacacgtcacaatctgatcaagaaatggctcattgatgttgtgtaaaataagtgaagatgacactccaaaacgacgatttctttgattttcactcagctcatgagacacccacttatcgagattttcacctttccaatttgcttcaaatgccaaaagaccatagaatggtcgacgtcgagttctttggcaacttctcatatagttgtaagaggatcagcttctcaattggtcattgttaactcccaatggccagccaatatgctcctcatcttcaaggctcttgtctcctgtgcaaaacttcttgaacatgactgtactgtaggcttattagcagttcctgggccaaag

SEQ ID NO: 92099 - DNA, 151 bp, Homo sapiens
tcccgtcacagcattaccgtgtgagctccgcctcccgccagagcattaccgtgtgagctccgcctcccgtccgagcattaccgtgtgagctccgcctcccgccagagcattaccgtgtgagctccgcctcccgccacagcattaccgtgtg

SEQ ID NO: 92100 - DNA, 280 bp, Homo sapiens
taccaatcagagttgtgtcatcaacctatatgaagatagtataaaaaaagtaattgtggcagtgatggctgtatttactgcaccgatgttgaagatatcacttaatacagattaattgtgcacactttctgaaaaatcacaggagacatttgttctgttctcagagaatattataattctcacagcaactgatctgtttagttgatgggtactgtaaattatgataatgctcattttctctcttgctttggctttcagaaagaccacagccaactttcta

SEQ ID NO: 92101 - DNA, 586 bp, Homo sapiens
taggaattattaaagtcctgtcagagtttatactgaacctctgacttgattttatccagctcatcaaagcaaaattgtcttagtagcactcttttgtagctgtttaatatttaatattcagtgggctccttaaggtgagttcttgaaggcttgtgagtagttgaagagctgtgaatggtggttaacaagctattatcatctccttgaaaagcataacatgaagcagagattcaggaaaatcttagacagtgattagtctatctgacagtgcatcaaaactaaattagttggccaagcacggtggctcacgcctgtaatgccagtactttgagaggccaaggcaggtgggtcatttgaggtcaggagttcgagaacagcctggccagcatggtgaaggcctgtctactaaaaatacaaaaattagctgggtgtggttgtgcacgcctgtagtcccagctacttgggaggctgagccaggataattgctcaaacccgggaggtggaggttgcagtgagccaagattgcgccactacaatccagccttccagcctgggcaacagagtgagattccatctcaaaaaaaaa

SEQ ID NO: 92102 - DNA, 305 bp, Homo sapiens
gtgagctaggattgtgccgctttactccagcctgggtgacagagcaagacccccgtctcagaaaaaagggaaacaaactgaaaacatgattgtaatgcagagaactgcaaaagacaactttaaaaacaatgctgaagcagtaaattacataaccgatgatacaaaaatttaagttgctgataaaacatacactggagaaaaacaatactaaagaatagataatggggtgatgtatctgaagaataaagtttgtaaaactagtaataacaggaggcctaaaagaaaaacagatagtaaaattggca

SEQ ID NO: 92103 - DNA, 642 bp, Homo sapiens
aaaatacattgacactgaaatgtcaatgggcaaacaccaatttcgccgttcattatgaaatacatcaaacaaaacttgccaaaaatacaaccataaaaatatagcaaatgtatgtatgagcaaactaatgctaaaaatgtctaattttcttggctagtctttcaaggaccagattcatgagtgttatttgaagggaaaaagtgaaatacttggaattattttgagtgatgtgctcctgagcttgttcttaaaatctaccagtggtagcttttggaaagaatgtgtttcataccgatgtgcaggcctcactggaagagcttcaagaggagtttgtgaaactcaaagtctaatggttttgattagaaacttccaggcaaatactctagagaaacttgggtgtaaaatgactaaacagatgaaaaggctttatccactattccatttgctccttacaccttaaaaagcttttttattttttaatgttttgatatatctagctttggggagaaagcagtgcaagagtgttattaaaagcagcttgtgttttcttgcacctttcacaccacccaggaaagaaaagttcaggcttaacagtgacatggctatcacatcatctgaataaattttttccttctaaaatta

SEQ ID NO: 92104 - DNA, 637 bp, Homo sapiens
ggtttcttaagtggggtgactttatggcatctttaatcatcgatcaatgggcagcaatcagaaacaaagttctcagcattatgcagttaatgtccttcatctacttctaacacttagtaaaggaattgattggctaggtataaaaagagaattaacgaaacctattttattggatctttaagtaataatatctaaatacatttcgttcaaacatacatatgtagctgtttggacattttggacaaagacacattgagttgatttttatttgtttttctgttccagaaacttcatcaagttacgggcctggtctaagaaaacacattgcaatctattttggcagacttctttcaaataaaatactaatttcattagctgatagtatagtaattggcaaacatttcctctttggaaataccaatttgggctagccattttgcagaaatttgtgtagttttgattataacctgttggagagcatttctaaattacttatacataaaagataatcttttttttgtttgtttttttgaggggaagtctcggtctgttgcccaggctggagagcagtggtgcgatctcggctctctgcaacctccgccccttgggttcaagcgattcttgtgcctcagcctcc

SEQ ID NO: 92105 - DNA, 828 bp, Homo sapiens
ggtttcttaagtggggtgactttatggcatctttaatcatcgatcaatgggcagcaatcagaaacaaagttctcagcattatgcagttaatgtccttcatctacttctaacacttagtaaaggaattgattggctaggtataaaaagagaattaacgaaacctattttattggatctttaagtaataatatctaaatacatttcgttcaaacatacatatgtagctgtttggacattttggacaaagacacattgagttgatttttatttgtttttctgttccagaaacttcatcaagttacgggcctggtctaagaaaacacattgcaatctattttggcagacttctttcaaataaaatactaatttcattagctgatagtatagtaattggcaaacatttcctctttggaaataccaatttgggctagccattttgcagaaatttgtgtagttttgattataacctgttggagagcatttctaaattacttatacataaaagataatcttttttttgtttgtttttttgaggggaagtctcggtctgttgcccaggctggagagcatgagccgagatcacgccagcgtactccagcctgggcgacagagcaagactccgtctcttcaaaaaaaaaaaaaaaaaagaaaaagaaaaaggaaaaaaaaaaagaatcatggctaggtaataaagtaaactggagattcactctcttcattagggtgggagccaagaatgtgcattgttgttgtgtatcctcagtgattcttataaggtggtccccacactacactttgagaaacagcaaataaaaggacttctttctc

SEQ ID NO: 92106 - DNA, 404 bp, Homo sapiens
gaaaaagaaagcagactacacccccgggtacttacataaatgagatcatttctgtaaacacagcgcagtagcagcatctagtataataagcactcaataaatacgagctattattgctgaggcaatgcatattggggctctttttctccatcctcttgtgtagcctaagtttgcagctgtgtttggcagccgcctcatactaatgaagcacactgggcttgggatcatttcagacctgcagatctcttttgcatgaaatgcaatggggccggggctccctcttctgcatttgtgcacctgcttttaagaacataatgaatgattggcatttgtctcttttcatttcatctaggctttggcccatcatcctaacctgttggcttcattttgaattttggattttg

SEQ ID NO: 92107 - DNA, 371 bp, Homo sapiens
tggctttttcctaaaaactaaaacaaaaacattcatagcaaagcagtttagcccagtgactaagagtatagacattggaatctgaaagatctgggttggaattctgcttcagccatttactaattatgtaacttcacatctctgagaatgggggaaattttctttgcagggttgttacaaagcttaaaagagttaagtcaagtgccctggaacagaacagccattcaataaatcatagaaatttttgtttttacacaaatttttaaaaagtaatattttttgcatttgttagaaagactatattttctgtttagtggatgacatcatcatcataaaaatcactgttacaagttttgttttgagaattaaaa

SEQ ID NO: 92108 - DNA, 365 bp, Homo sapiens
gaagtgccatttatatttatacaaaaatattacataattcagttagtattggtgacataatttagttagtatgggtgatataatggtcataatttttagcatctaataaagatctttttatgagtcccatataaaatatgtgaacaaagcaatcttgtcataagatttgtgatgatttaggagaaagtactttgagataatttttttctgtctctttgtgaactctctcaacagtagttctctttagattagagccagcaggtcggccataacagttttcttcaaatttgggcaacagttatacaaatgcttgaatttcaagacaacatattaaagggtctatgaactgaaaatctaacctggtt

SEQ ID NO: 92109 - DNA, 294 bp, Homo sapiens
tatagttccagaatatttttgtctttaacattactatatgtatttctaacatgtttcaagcacagtgtgttcaaaatagagtccttttttcccctctcattccaatctatcccatcttgagtctcctttatttcagtcaataaaacagaatcatcaaaattcatacatgtacatataattaattgtttctcaaataaaaaacataatccttatagtttttgttcctcagtttctctcaaacttcaattcttttataaaactttacatgcaaacagtagcagacatctgtatatt

SEQ ID NO: 92110 - DNA, 147 bp, Homo sapiens
cagagggatctgacctcccctcccccttagattataaggccttctagggggtggaatcttatttgattcctattgcacatggaccaacatgcactaacatcatgaactagaagtttcattgctgctagctgcagtgcctggagcatc

SEQ ID NO: 92111 - DNA, 206 bp, Homo sapiens
gtgctgaaattaaagctgtgagctgctgtgctggcctcatcctttccttttgataccaggtgcacatcttggagtttgtcttgaaaacctctgcctttcattcctgtgatcctcagcttttcttgatttcttctgactgtgaagactcctcctttacccagggtttagccccacagggtttctttctcagccctccacaggcctct

SEQ ID NO: 92112 - DNA, 543 bp, Homo sapiens
  misc_feature (58)..(58): n is a, c, g, or t
  misc_feature (209)..(209): n is a, c, g, or t
  misc_feature (249)..(249): n is a, c, g, or t
ggggtttcctgcttcaacagtgcttggacggaacccggcgctcgttccccaccccggncgccgcccatagccagccctccgtcacctcttcaccgcaccctcggactgccccaaggcccccgccgccgctccagcgccgcgcagccaccgccgccgccgccgcctctccttagtcggcggcggcggcggtggttctccttagtcgccgncatgacgaccgcgtccacctcgcaggtgcgccagaactancaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcgatggagtgtgcattacatttggaaaaaagtgtg

SEQ ID NO: 92113 - DNA, 477 bp, Homo sapiens
  misc_feature (58)..(58): n is a, c, g, or t
  misc_feature (143)..(143): n is a, c, g, or t
  misc_feature (183)..(183): n is a, c, g, or t
ggggtttcctgcttcaacagtgcttggacggaacccggcgctcgttccccaccccggncgccgcccatagccagccctccgtcacctcttcaccgcaccctcggactgccccaaggcccccgccgcctctccttagtcgccgncatgacgaccgcgtccacctcgcaggtgcgccagaactancaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcgatggagtgtgcattacatttggaaaaaagtgtg

SEQ ID NO: 92114 - DNA, 226 bp, Homo sapiens
ggtgtggcgctctgaggatccccctctcctcatgagatggtgaagaaagtattggcaatttcttcaccaatctcatgaggagagggaacatgctgagaaactgatgaagctgcagaaccaacgaggtggccgaatcttccttcaggatatcaagaaaccagactgtgatgactgggagagcgggctgaatgcgatggagtgtgcattacatttggaaaaaagtgtg

SEQ ID NO: 92115 - DNA, 1870 bp, Homo sapiens
tccattcttttcaatataggctttaattcaaaatgcactcaaggagagggaagggagggactaggacactgtttagaaggggtaattacactaaatacactgaccttcgctgaaaaatagaagggacaggtggctacagaagccagctcttaccccttttgccgtccccaccccataccccaaaccatcttggtttcttgactcctctggtccagtaagaacctacaaacgtgtttgtttgtttttgttttaacacttgaggttgtgattaaacaatccccaactcgtcttcatctcttttttctgaagttgcttttattaattgaatttttaaaaatctggtttcatctccacgtgcattttcccatcgttcttcagatttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtgcggctgtagcccgcgctgtaatcgtaggacacctgatggggcggcggcggcgggggcagggcgcagtctggaaagaagggggcgaaagaggccaaatggccccggcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtagtcgggccccagcagctcaaagaactccacggcctccgcgcccttctccaggtcgcccaagctcacgtccggccccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccggggacgtggcgcagcgagtcgaagagcgcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagcttgatgttgctggacgccgagtcaatgaagctgagtagatcgcgggtggcctcgcgcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcct

SEQ ID NO: 92116 - DNA, 1895 bp, Homo sapiens
ccaccccagaagtttgttaaataaataatttcaatgcaaaaagggctttaattcaaaacccatccaagaaatggaaagcgatttaatagaaaagcttttaatacgggtaattacactaaatacactgaccttcgctgaaaaatagaagggacaggtggctacagaagccagctcttaccccttttgccgtccccaccccataccccaaaccatcttggtttcttgactcctctggtccagtaagaacctacaaacgtgtttgtttgtttttgttttaacacttgaggttgtgattaaacaatccccaactcgtcttcatctcttttttctgaagttgcttttattaattgaatttttaaaaatctggtttcatctccacgtgcattttcccatcgttcttcagatttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtgcggctgtagcccgcgctgtaatcgtaggacacctgatggggcggcggcggcgggggcagggcgcagtctggaaagaagggggcgaaagaggccaaatggccccggcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtagtcgggccccagcagctcaaagaactccacggcctccgcgcccttctccaggtcgcccaagctcacgtccggccccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccggggacgtggcgcagcgagtcgaagagcgcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagcttgatgttgctggacgccgagtcaatgaagctgagtagatcgcgggtggcctcgcgcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcct

SEQ ID NO: 92117 - DNA, 1059 bp, Homo sapiens
tccattcttttcaatataggctttaattcaaaatgcactcaaggagagggaagggagggactaggacactgtttagaaggggtaattacactaaatacactgaccttcgctgaaaaatagaagggacaggtggctacagaagccagctcttaccccttttgccgtccccaccccataccccaaaccatcttggtttcttgactcctctggtccagtaagaacctacaaacgtgtttgtttgtttttgttttaacacttgaggttgtgattaaacaatccccaactcgtcttcatctcttttttctgaagttgcttttattaattgaatttttaaaaatctggtttcatctccacgtgcattttcccatcgttcttcagatttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtgcggctgtagcccgcgctgtaatcgtaggacacctgatggggcggcggcggcgggggcagggcgcagtctggaaagaagggggcgaaagaggccaaatggccccggcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtaatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcct

SEQ ID NO: 92118 - DNA, 621 bp, Homo sapiens
taagcattaacattttcctatcagttaagctttgtagctcccaggttaaaaaagcacctgatcttcaaaaaatacagttgaatgagtcatctaattaataaatagtatttaatgatgctttagatcattttcatttttaaaagttataatgaatataaagaatctatcagtaagatgttgtgtccatcagtaaaagctattggaatggaaatttgattttggcttgtaaagcaaaatgtatctgaaacagatctcagtcaatttagtttattttgccaaggttaagggcatgcacctaggagacaggtctgtgcctttctctgaagatgagaatattgagacttcatatttaaagggaaaaggcaggctggaggggaaagaagaaggtggtcacattactgaatccacatgttgcaagagtgaacactttacagacaataaggtgaacatagagtaactacctgtggagatatttaacctcttatctgtagctctctgcttaggagcaaaaggaaaggcagcttcttgcgtgactcagctttcagcttaatcttcttccctttggcagagtgaattgggggtcccaagtttttattttcctttcacagacataatttcatg

SEQ ID NO: 92119 - DNA, 675 bp, Homo sapiens
taagcattaacattttcctatcagttaagctttgtagctcccaggttaaaaaagcacctgatcttcaaaaaatacagttgaatgagtcatctaattaataaatagtatttaatgatgctttagatcattttcatttttaaaagttataatgaatataaagaatctatcagtaagatgttgtgtccatcagtaaaagctattggaatggaaatttgattttggcttgtaaagcaaaatgtatctgaaacagatctcagtcaatttagtttattttgccaaggttaagggcatgcacctaggagacaggtctgtgcctttctctgaagatgagaatattgagacttcatatttaaagggaaaaggcaggctggaggggaaagaagaaggtggtcacattactgaatccacatgttgcaagagaaaagaaatagataggggaatagtcaattatgtattcatctcacgctcagtaaatgaacactttacagacaataaggtgaacatagagtaactacctgtggagatatttaacctcttatctgtagctctctgcttaggagcaaaaggaaaggcagcttcttgcgtgactcagctttcagcttaatcttcttccctttggcagagtgaattgggggtcccaagtttttattttcctttcacagacataatttcatg

SEQ ID NO: 92120 - DNA, 370 bp, Homo sapiens
aataattaccgggtaattagatggcaggcatgataggtgccgggtactggtttccaaggggacttcgaaaaggtattctgccgccctatgcctcctcccagtacaaggcacagttaatgcctcagatcccacaccgcctctctcgtggaagtgtgctctgagccactggggcctaagccgagttgacaggctccattagagagcgactctgtcatggaaattgtgatcttaacagagggacatgtggcagataccaattccactcacatccttgtactacgtggctttcccagggggctacttgatgggatcaagggatgttcacaccaccagtccccaactgccttcatctgacctgacctgtacggcc

SEQ ID NO: 92121 - DNA, 288 bp, Homo sapiens
ggcagtggggaagaggagagacacactgttcagagctctggcaagatcagacactgaggaagtacagtgtctgtgaggctctgatgaagggcgcaggtttcctctctgttaacagctagccgggcacaggtggagctgctgaacctgaggctcaggcctcagttctctgcctgtgcttgctgcatcccctggctcacaagtcaaacttcaggcaggcaagaaggggaagaggtgtcttccttaaaatagcttgcacttgaatttgaaattgtctcagtccctgggcta

SEQ ID NO: 92122 - DNA, 906 bp, Homo sapiens
attcacaggaagtcaaaaaaggacctatttcaattatgtctgcttgaatcctgtttaattgtttccctggctgagtagctagtgtgacacagcagcaagactaaaggggctctgtggtccacattgtcctcgagtctattcttgcccattatagacctgcccattggtgctcactcactgcatcccaggaggcttgactgtcctcaggaagcatgttggggtgcccttaagggtaagtatcccggggagcacagtttggagaaaaccaatacgtcttcatgtatgttgagaagcgctgggccaaagtacagactttttttttttttttttttttgggggaaaaaacctgggttttgtcccccgaggggggggggcggggggccccccgggcgtggtgggcaccctccaacgcctcccgggggtcacaacggcacactccctcccacctataaagctccccgggaggaaagcggggagacaacggggggtgcatatttcacaatgtgccggagctaaaactttccacgcggagtattttactcaacataaaggcaaggaggggcacacatatatggttagccccagggctgtcgcctcgggagaactctctggggggcacaaggaaagccctcccaactcggggcccccccaaaaggggctgggatatcaggcaccggctttgacccaccaaaagctggggcctaactgtggcgagaatttgcggaactcttggtggcctgccacccccagaaggcagaagaattcccctgggagcgaagccaaactatcattcagggcgagaggtcttcgagaaaccgggggtgcgaactgtaaacagtgattcaacaacagttcccgggcacaacaggggggcggcccctctaaatcatggaaagagacgggttg

SEQ ID NO: 92123 - DNA, 843 bp, Homo sapiens
gaaatccacgcatttacagccaactcatttttgaaaaaggcaagaagaataatcactggggaaaggacagtctcttcaataaatccagctgggaaaactatatgaccatacacagaagaataaagctagatccctatttctcatcatatacagaaatcaactcaaaatggatttaaaaacttaaatctggctaggcgtaatggctcacacctgtaagcccagcactttgggagaccaaggcgggcagactgcttgagctcaggagtttgggaccagcctggtgaaaccaggtctttatccaaaatacagaaaattagctggatgtggcagtgcatgtttgtggtcccagctacttaggaggctgaggtgggaggatcacttgagccccggagttcaaggctacagtgagctgtgattgtgccataattcactgcagcttgaatgacagagtgagaccttgtcttaaaaaaaaaaaaaaaaaaaaagtgtaaatctcatacctgaaactattaaactactagaagaaaacactgcaaaaatgcctcaggacattggtctgggcaaaaactttttgggttggacctcaaaaacacaggcaacaaaggtaaatgtaggcaaatgggagcacatcaagctaaaaagcttctgcagagcaaaggaaacaacaaagtgaagagataacctgtttataataggagaaaacacctgtaaactatccatccaatgaaggattaataaccagaattacaaggaactcaaaagcaaaacaacaaataatccaattgtaaaatgggctaaagatttcaataaaaagaagacatacaaatagccaacacgtacatg

SEQ ID NO: 92124 - DNA, 2275 bp, Homo sapiens
gagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagttttctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagtttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaaaaaaaaaaa

SEQ ID NO: 92125 - DNA, 2258 bp, Homo sapiens
gagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagttttctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagtttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttggctgtaaaatcatatatttactatgtttgaaagaaat

SEQ ID NO: 92126 - DNA, 404 bp, Homo sapiens
gtgttaaattaattttaataaattatataattactacatattgtaaaataaagaccggtattttattttctgccccccgcaaaaaaaaaaaaaaaaaaatttttgcccccccccccttttttccccttttggggggccccttttttttccccaaaaaaaaagggggcctttttcttcttttggggaaaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaaaaaaaaaaa

SEQ ID NO: 92127 - DNA, 2221 bp, Homo sapiens
gagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagttttctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagtttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaaaaaaaaaaa

SEQ ID NO: 92128 - DNA, 286 bp, Homo sapiens
gacggttaggaacaggtaactaaaggtgacttaggtcagagcaggtgaccaggggtgactcaggtccaacaggtgactgggatgagtcaggatgaagcaggtgaccaggggaacaaatgtgaactactgattaggactggtgggaatgctgtttactgaaactaggagcaaggagacgaagagaaccagaaagttaaactttaaaatggagaatcaaagaataggagacctgaacgtactgacatactgattctttgaagagaaacttggggttcactatatttaa

SEQ ID NO: 92129 - DNA, 793 bp, Homo sapiens
agaaaatgtatgcataaatgttttgcacctggaaggccctcagtaaatgctgttccgcttttttccttaaaaggctgctgctccttcaatttggtatgctgacatccagtggtggtgctgtggcattagtgtgtgagtttcacaggagccacactgcttagtcttgcatcctggctcatccgtagctcaccctgtaactttgggcaaggttacctcactgtcttgtatttcagttttctcatctataaaattaagatgataataatcatagtacctgccctacagggacattgcaaaaattaaatgagttaggcccttagaaatgggcctggtatatgctaggtacagttggcccttgaacaaaatgagtttgaactttggattttattctgcctctgcctgtccaagacagtaagaccaacccctcttcttcctcctccgcagcctactgaatgtgaagactatgaagatgaagacctttatgatgatccactttcacttaatgaaggaaattcttcctgcttctccatgctcttgatttggaggcaggaaaggactgtgaatgttgcaatggaatgcgtttgaaggcaagggccccagtctccactcctagcctctttcacttccccttcctcgcaattactctttattgccaagagaagattacgcagaagacagcctctccatgaagcatcttccaagtggctgatactacgaagactccataaagtcccacttaccagcacaggatggaacagatcctatgtcaatacatccagacttttggctagaa

SEQ ID NO: 92130 - DNA, 444 bp, Homo sapiens
tactgtgatcacaaataccaccatgatctatgaaaggacgatgatctgatttagacttgccaaattgccgttgcagaaattcttcctgcttctccatgctcttgatttggaggcaggaaaggactgtgaatgttgcaatggaatgcgtttgaaggcaagggccccaggtgaggagtgtatatggttttgtgtgttgcacatatgtgggtgccatcccatgaagctcattttggaatgtctcttttccccagtctccactcctagcctctttcacttccccttcctcgcaattactctttattgccaagagaagattacgcagaagacagcctctccatgaagcatcttccaagtggctgatactacgaagactccataaagtcccacttaccagcacaggatggaacagatcctatgtcaatacatccagacttttggctagaa

SEQ ID NO: 92131 - DNA, 902 bp, Homo sapiens
agaaaatgtatgcataaatgttttgcacctggaaggccctcagtaaatgctgttccgcttttttccttaaaaggctgctgctccttcaatttggtatgctgacatccagtggtggtgctgtggcattagtgtgtgagtttcacaggagccacactgcttagtcttgcatcctggctcatccgtagctcaccctgtaactttgggcaaggttacctcactgtcttgtatttcagttttctcatctataaaattaagatgataataatcatagtacctgccctacagggacattgcaaaaattaaatgagttaggcccttagaaatgggcctggtatatgctaggtacagttggcccttgaacaaaatgagtttgaactttggattttattctgcctctgcctgtccaagacagtaagaccaacccctcttcttcctcctccgcagcctactgaatgtgaagactatgaagatgaagacctttatgatgatccactttcacttaatgaagggtcaatatattttctctttcttatgattttcttaatcatgttttttctctagcttactttaagaatacagtgtataatacatataacatatacaatatgtgttaattgactgtttatattatcaataaggcttccagtcaacagtgggctatcagcagctgagtttttggggagtcaaaaatcatatgtggatttttgactttgcagggctcagtgcccatcatgtccacattgttcaaagctcaactgtactttattacagtgtcttttattgttaatttgcaatctaataagatctggactgttttttttgggcctaccagatctgactatagattttttgttcttgatacctgtataggacaggaatgatgattaaaacatacttctcaa

SEQ ID NO: 92132 - DNA, 296 bp, Homo sapiens
ggatggtagatttctatgtaaacattgttggggtttattgttgttgttattggtttttaagtgacaaatggtacagacttggaagtcttcaaatattaaaagcaaacaaaaccaaaagaatccctttaggaaaagtcagctaatgtttttgttccttttctgatggttttttgtcttactacttttacccattgctcaaatcatgttgaaggttttatcaaggtccagtttatggacttcatctcgtactacatcaaatagggcctaaggagcccatctgatcatctgatctcatt

SEQ ID NO: 92133 - DNA, 233 bp, Homo sapiens
tgggctggatttggttattcacttacaacaaatagaatattgcaaagtgatgcgacgttacttctgaaattaagttataaaaactttgtggcttccatcgtatgggccttttctctaagatccctcactctggaggaaacaagctactgtgttgtcagccactttatggagaggcccacatggcaaggaactgatatctctgggcaacaaccagccagtgaaaatctggcctg

SEQ ID NO: 92134 - DNA, 380 bp, Homo sapiens
ctttgtgctttaaagtgggacattcatgctcttcctgcccaggctgatccaggtatcctgaagatcaaatctgttaatgctgcagagttcaattcagtaaatgtttaagtgccccctatgtgccatgcttatgaaaacactttggaaattatgcaactacaaggtaatgcaatcataactgtttggctagagattatgagtaagggttgcattttgtttcttcccagtatacacagtccacattgatgttaacctgccaccactcagcatggaatcttgtatttcagtgacttggttgaatgtatgtgtatgtatggcttttgccttttatgtatattcgctgtggagtacaaaggaaaaacttggttttaattaaaaac

SEQ ID NO: 92135 - DNA, 3621 bp, Homo sapiens
atgaagaagctagggagaattcatccaaacaggcaagtgttggcctttattttgatggtgttcttgtctcaggttcgcctcgagcctattcgttattctgtgttggaggaaacagagagcggctcctttgtagcccatctggccaaggatctgggcctgggaattggggaactggcctcccggtcagcccgggtgctgtctgacgatgacaagcagcgtttgcagctggatcgtcagactggagatttgcttctgagggagaaactagaccgggaagagctctgtggtcctattgaaccgtgtgtactgcatttccaagtgttcctggaaatgccggtgcaattttttcaaggagaattattgatccaggacataaatgatcactctccaatattccctgaaagggaagtgctcttgaaaatactagaaaatagccagccgggtactctatttccgttgctaatagctgaggatttggatgtgggcagcaatggtcttcaaaaatacacaatcagccccaattctcattttcacattctcactcgaaatcatagtgagggcaagaaatacccagatttggtgcaggacaaaccactggatcgagaggagcagcctgagttcagcttaaccctcgtggcgctggatggtgggtcaccacctaggtctggcacggtcatggttcgaatcctgatcatggacatcaatgacaatgctcctgagtttgtgcacactccatatggggtgcaggtcctggaaaacagccccctagactctccaattgttagggtcttagctagagatatagatgctggaaacttcgggagtgtttcttatggcttattccaagcatcagatgaaattaaacaaactttctcaataaatgaagtcacgggagaaatactgttgaaaaaaaaattggatttcgaaaaaattaaatcttaccatgtagaaattgaggccacagatggaggaggcctttctggaaaaggcactgtagtcatagaggtggtggatgtgaatgacaatcccccagaacttatcatatcttcactcaccagctccatcccagaaaatgctcctgagacggtagtctctatcttccgaattcgagatagagattccggagaaaatggaaagatgatttgctctattccagataatctaccgtttattctaaaaccaactttgaagaatttttacaccctggtaacagagagaccactggaccgagagaccagcgctgagtacaacatcaccatcgccgtcactgacttggggacacccaggctgaaaacccagcagaacataaccgtgcaggtctccgacgtcaatgacaacgcccccgccttcacccaaacctcctacaccctgttcgtccgcgagaacaacagccccgccctgcacatcggcagtgtcagcgccacagacagagactcgggcaccaacgcccaggtcacctactcgctgctgccgccccaggacccgcacctgcccctcgcctccctggtctccatcaacgcagacaacggccacctgttcgccctcaggtcgctggactacgaggccctgcaggcgttcgagttccgcgtgggcgcctcagaccgcggttctccggctttgagcagcgaggcgctggtgcgcgtgctggtgctggacaccaacgacaactcgcccttcgtgctgtacccgctgcagaatggctccgcgccctgcaccgagctggtgccccgggcggccgagccgggctacctggtgaccaaggtggtggcggtggacggcgactcgggccagaacgcctggctgtcgtaccagctgctcaaggccacggagcctgggctgttcggcgtgtgggcgcacaatggcgaggtgcgcaccgccaggctgctgagcgagcgcgacgcagccaagcacaggctcgtggtgcttgtcaaggacaatggcgagcctccgcgctcggccaccgccacgctgcacgtgctcctggtggatggcttctcccagccctacctgcctctccctgaggcggccccggcccaggcccaggccgactctctcaccgtctacctggtggtggcgttggcctcggtgtcgtcgctcttcctcttctcggtgctcctgttcgtggcggtgcggctgtgcaggaggagcagggcggcctcggtgggtcgctgctcggtgcccgagggccctttccagggcatctggtggacgtaagcggcaccgggaccctgtcccagagctaccagtacgaggtgtgtctgacaggagactctgggactggtgagttcaagttcctgaagccaatatttcctaatctcttggttcaggacaccgggagggaagttaaggaaaaccccaagttcagaaatagcttggtattcagttaagtattgtatttagttcagtgaaccgcccgttagttttgtcaaacttcccactgcaatgcctttatttaaaaaaattgtctacttatctaaatattcataccacaatttcaaacctactcatgtccctgataaagctaaatttgtcccttttttattgttattaattgcacttaacatttttagttatactggatattgagtatggattttctctatatttgatctattggtgattaatctttttgtaatcataaattactcaattaggataaaaataaattatgttttaatgaaattcttaaattaacatctttttaatggaacatttaagtgaatatatgaatattgaatttctaaatatttgttgtgcctgtctttaccatgtaacttaatgtttgcaaggccagagtgtttgaaagttttgtatttaactttataattaccttgtcctttctggttgactatactaggctaagccctcttaatagccatgagtgtaaaatttagtttactcatttttcacaaattgtatataaacatgcacttcactacattggtaatacactaaaattgtggtccttttcctcttgtgaccaccacatgtctagtgattattttgtttatttggttgctacttacctagcacattgtaatgttccatgaatgctaatattaaattttgtaaaaataacttatttataaataatttttaaagagaaaaatctcatataatttgtcataacctttcaataaataaaactgttaaatcatggcctgatatcatcttaaaaaaaaatctcagaatctgaaataagccctaaatttctccccaaaatcaagactcttgagagcatcataggtctccttgtgctaccttttactccctataaatagaaatccaagtatactttaatatgtgtatattttttggttttcctacagcttctccccatctttcaaaagaatcacgaaatttcttctgcaccttggctattctgtttaaatctgataatcagttgatctcaggtttttcactgtacattactttgcagatatggacagcctttacaaaaataatttttaaatgcttaattattttaatttgttctttaaggtaaccttcagttattttgaattaatttaacttctcaattatgccaaagttgcacttgcatgaaataaatattattttgtccttgtatagactggaacagtaataaatttatctgaatta

SEQ ID NO: 92136 - DNA, 2809 bp, Homo sapiens
ttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcgttggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttca

SEQ ID NO: 92137 - DNA, 2495 bp, Homo sapiens
ttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgagagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcgttggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgaggga

SEQ ID NO: 92138 - DNA, 2748 bp, Homo sapiens
ttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcgttggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttca

SEQ ID NO: 92139 - DNA, 1841 bp, Homo sapiens
gtttttggcaggtctgatttaagaaaaactgaaggtgtattttcacatagtatgtcagtggtagacttcgtaattagactaaatcgtgtatatttttgcaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcgttggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttca

SEQ ID NO: 92140 - DNA, 2222 bp, Homo sapiens
ttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcgttggaatcctcatcctggtcctcattgtagccacagccattcttgtgacagtctatatgtatcaccacccaacatcagcagccagcatcttctttattgaggtaagtgttgagtttaacacatgaaaaccacgccagttgatgaactgtatccgtttgctaacacc

SEQ ID NO: 92141 - DNA, 360 bp, Homo sapiens
taacatatagttacctgctttgtttttttccagattcctgtcttggtcacacagataagttcaaccaatcatccagtgaaagtcggactgtccgatgcatttgtcgttgtccacaggatccaacaaattcccagtacgtagaagaagggcagtcgcaatgagtgagcctctgtgggggtaaatttaaaggagattggtctatggcagctgtacctgaattaaaaaaaaaatagctaatcgattagctgattaatgcttgttaattctgttgtttgctttataactccgattgggctatctctgtcacccttgagctaactcaggtaaagacaaattaaatagtgaagccaaaaatgtgta

SEQ ID NO: 92142 - DNA, 490 bp, Homo sapiens
agacttttgctgtgcagacgctgtttagttaagtcccatttgtctatctttgattttgtggcatttgcttttgagatctttataataatttatttgcccagggcaatgtctagaagagtatatcctagattttcttctagaacttttatagttcgtggtcttacatttcagtcttaattttgagttaatttttgtatatggtgagagacagggatccagtttcattcttctgcatatggttagctatttattgaatagggtgtcctttctccattggttattttggtggactttatcaaagatgagttggttgtaggtgtgaagctttatttcaggggtctttattctgttccattggtctacgtgtctatttttgtatcagtactatgttttggttactgtagccttgaagtatagcttgaaatgcagtaatgtggtgtaaggctccctatcctgttttgttctttttgtttaggattgccttggctat

SEQ ID NO: 92143 - DNA, 462 bp, Homo sapiens
tgggtagggaaggaggaccaatatcagaaggtgacatttgaacagtgactaaatgaggggccggagggagccacgtggcctagcggaagagcactccaggcagagggaacacaacaaattcgaaggctcaaaggtggaggtgtgcaagggcaagaaggggagtgaagggcgtgtgaaggatggagaggaggtgggggcagatggtggggcctgccacactgtgtaagtttcacttggttctaagcaagactggggccactggagagtttgggcaaaagaatggcatagtctggccaggcgcggtggctcatgcatgtaatcccagtgctttgggaggccgaggcaagtggatcacctgaggtcaggagttcgagaccagcctggccaaatgaaaccccgtctctactaaaaatacaaaaattagccaggcatggtgtcgagcgcctgcaatcccagctactc

SEQ ID NO: 92144 - DNA, 457 bp, Homo sapiens
ctctacttcaagggcacccctactcacacacacatagctccattgccaccacccttagctatcatttttacatagctcaaaaatcacttcttcatagcaatctcccttgacattccagataagattagtctcctgcaattgactttcatagtattacatatatgtttttcataaaagctggtttaacaagtaagtgtgtattgatccaatgataaaattccatggcaaacaatcagttcaattcagtaaacatttactgagtgcctactatatgcctgacccagtgtattgttctcacaaccagagaagacagccacatcttttaaaataaggaaaattatgctttcaaagaaaagtacaaccctcatttcaactgactgaatgtttatcaagtacttatcatatgcaagatacaagggaaagaaactctctctggagggactcatagactagcaaa

SEQ ID NO: 92145 - DNA, 410 bp, Homo sapiens
aaacaaaaccacaaacatttgtaatatatttttatagagcaaaatgtaaaacctttgtacagccacatcacatagctttttcttcttgacaaactccccacccaaccctcagagcttaaagaggttgaaggccctgttcaaagagaagacaactattttttaatgatattttccacaactaagtcaatgtctatacagcattttgatttaataaaaacattatctcttggcacatatcttaaaggatcatgattttaaaaatatatgctagtcagcaacaggccaggacaaaaacaccacactcaactttgaaaagcaaacggttccaggctagagggccttacattgctcagctttgggtacatttttcaattaattaattgacatttatgttggctgtatttgctatg

SEQ ID NO: 92146 - DNA, 410 bp, Homo sapiens
tttaacaacctgcaactttggatgatcatatgattggtcttcatttcttgattattctgactggtgtttctttaaaagtgccaatctttaaaaagataaatgctgtttgtctctcaaaacagtcataaattgtgggaaaggaaacaaagacgaaaacattagtttttcagaaatgaggctttttgttaaaagtaaaataaaaatagcaacacaacttcctgattttctgagtgaagttatttcatgtgctagttatttggtgtggctcctcaagcccattttaattgagatggtgtaggcagctaaaagaaatgcactggtaaaaccacaactaggtttcatcttgataggcaggagcaaaaacagaaaggaaagaggccagcctaatttccagagactggggggttaca

SEQ ID NO: 92147 - DNA, 635 bp, Homo sapiens
gactgaattcagccagctctccttagaagttattttctcagatcttattgccatcttttcattctttctgatctgcattagtcttactttgtggaacatggcagtaggcctgggactcttagagagtccccatccttgtaatgagcaaaaagaatattgttgcgcattcctatcgggctcttaagatttcttcccaaccatactgctttctaggtaccactgtagtgcccttgtaacccttagatcttttcttgctgtgttcaacacagagcctggcatactataactgtagctggtttctcccatttccttctggattccacatggccccctattctatttcatccttttgggaatgtgtaatctttgacacttatattcctaaacccactttggtataatctggaaactttatggcatgctctagtctgtgacaatcaggataaccctgattataccagcttctaatcaactacataaagcgggtgaacaccagggtcaccaacacccatttcccaactgcggtgcacagcagctttttagctttgccaacatttgggccggcacatgtgtttgtgcgtgattatttgtctcatgtactattgaataaacgtctttgtaagtaactatgaatg

SEQ ID NO: 92148 - DNA, 450 bp, Homo sapiens
accttatcttatgtaaagtgcccacttaactgagcatgagacaaatacatcattgactattcccttacctgctccttttctctggcaacatgtggattcaatagtgtcaccagaccctccctctttcctctctagaccgcttttctcttttaagtattgaaggcttcgggctgggcatggtggctcatgcctaataaaagagggcttatggcctcttttatttatgttttgagacgggatcttgctctgtcacccaggctggagtgcaatggtgtgatcacagctcacgatagccttgatctccagggctcatgcgatcctctcacctcagcctcctgtgtagctgggaccacaggctcacgctaccatgctcaggtaattttcttttttttttgagatggagtctcactctgtcgcccaggctggagtgcagtggcaccatcttgggtc

SEQ ID NO: 92149 - DNA, 841 bp, Homo sapiens
cataatttaaggctctaagaaggtggctgcacttggatctcttacaaagcatcatattttcaatgaggagaccattgaagtgatgtcacgtggctgttcatctgacctgagggaagaatgaaaaggaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtaacacaggagttctggagaaggaacgagccagacgcctcattcacaactacaatctcatttacaacctgtccctgagccctcagaaaatcgaccaggccttgcgcagattccgttcgggagaaaatatgctcttggagccagcactgcggtacttaaaggagctatgataacaagcccatattgtgagaacagatgtttcccttatctccctttttacccagacacatgtttctccccagcctaagtgtagtggcggaggcattgtcagagtggaggccgatgcagctattgtagatgcttttgatttggacttagtttctggctatgatgctcactcataagcagttcaaagtgatcagaggaaacctagttttatcttttgatgtggcaagaacccagctacttagaatctccttctgttttaataaaacttattattaatattaaa

SEQ ID NO: 92150 - DNA, 790 bp, Homo sapiens
agcttcctggggagaagcacggaccgcgcacctctgagctgccagggtggggacgctgccctagcgggatctgaagggattttgaaaggaatcatgtcttcagcctggaagactccccgtggatcagatgcaatgcctgagatcatggtgaaaatcattggaagtaaacactttcaatacctcgtggagaagccaaagatcaaggagaatgacagcttgaaaacagaaacccaaacaatgcaccagaaaccaatgactgataatgcaaggcagatgagcagagacaccccagttcccattaacttcactgatcagcaaaccactgataatccagatgatgtgaaagagaaaaagcacccagagaacaaccagaaatcagaaaacaaccagaaactactaacaggggcaaacagtagcagattcctggatggcaatattcccagtcaagcaaatgtccactgcagctctgtaccaaccggagaccagtccttatcctatgtgcatggcattcccaggagaaagcttagagactggtccttggaacagatggtgagaggcagctctgaccaacctgaggatattggccagagcccaagtgggacaacaaatgaagacgcttttcttcttgccctggtcagaagagaactcaagtcacgtcctttgagttccaacttattagaaaagcttcagaaagagctgaagatcctggacccaatctcttcaggatttcttctccaatctcagctgagccgcctctttttgaagcatgaagtccctctacagttaccaa

SEQ ID NO: 92151 - DNA, 1328 bp, Homo sapiens
agcttcctggggagaagcacggaccgcgcacctctgagctgccagggtggggacgctgccctagcgggatctgaagggattttgaaaggaatcatgtcttcagcctggaagactccccgtggatcagatgcaatgcctgagatcatggtgaaaatcattggaagtaaacactttcaatacctcgtggagaagccaaagatcaaggagaatgacagcttgaaaacagaaacccaaacaatgcaccagaaaccaatgactgataatgcaaggcagatgagcagagacaccccagttcccattaacttcactgatcagcaaaccactgataatccagatgatgtgaaagagaaaaagcacccagagaacaaccagaaatcagaaaacaaccagaaactactaacaggggcaaacagtagcagattcctggatggcaatgtcagggctatatgtgggaagcatggattatatctgaccctgagcctgctggaaacattgcttaaccatcaagatttgggttaccaaaatgaaataaaatggcagaattttgttgagatgctgaccagagcttcttctgatttgttatctgatttgcctacagggaagaatgaaaaggaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtaacacaggagttctggagaaggaacgagccagacgcctcattcacaactacaatctcatttacaacctgtccctgagccctcagaaaatcgaccaggccttgcgcagattccgttcgggagaaaatatgctcttggagccagcactgcggtacttaaaggagctatgataacaagcccatattgtgagaacagatgtttcccttatctccctttttacccagacacatgtttctccccagcctaagtgtagtggcggaggcattgtcagagtggaggccgatgcagctattgtagatgcttttgatttggacttagtttctggctatgatgctcactcataagcagttcaaagtgatcagaggaaacctagttttatcttttgatgtggcaagaacccagctacttagaatctccttctgttttaataaaacttattattaatattaaa

SEQ ID NO: 92152 - DNA, 905 bp, Homo sapiens
gcagaagcagtggtgagaggccagtggcacggagacagtttttatttatttatttatttatttatttatttatttatttatatcaacagcagtagcaactgcagaaactgatggcagaattttgttgagatgctgaccagagcttcttctgatttgttatctgatttgcctacagggaagaatgaaaaggaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtaacacaggagttctggagaaggaacgagccagacgcctcattcacaactacaatctcatttacaacctgtccctgagccctcagaaaatcgaccaggccttgcgcagattccgttcgggagaaaatatgctcttggagccagcactgcggtacttaaaggagctatgataacaagcccatattgtgagaacagatgtttcccttatctccctttttacccagacacatgtttctccccagcctaagtgtagtggcggaggcattgtcagagtggaggccgatgcagctattgtagatgcttttgatttggacttagtttctggctatgatgctcactcataagcagttcaaagtgatcagaggaaacctagttttatcttttgatgtggcaagaacccagctacttagaatctccttctgttttaataaaacttattattaatattaaa

SEQ ID NO: 92153 - DNA, 338 bp, Homo sapiens
cctactgaaaaacagagtcattcaactataagattattgagtgatttaaactctgaaagtcaaaatgagatttgagctaatatttcaattattttcaaacccagtatattacaactgctattaaactgtaactttaccacaatgcactatgctaaagcacaaagcctcaacagtacataaatccctcttggcctcatttggtagaatttctctacccatgagacagtctgaagaggtcacttcctacaagtcagggaaacaaaggttgtacacctacagatcaaagccaataacaaaacatcaggtcccaagacaatatttagcacagaaggaccttt

SEQ ID NO: 92154 - DNA, 189 bp, Homo sapiens
tactgcctaatcaacatctctacttatatttaacccactgcatctcaaacttaacatgtccaaaactgaacttttgattctttccatttctctacacctgttcctcctttagtattccccagtgttgctcagaccaaaaatctaggggtcatgactgactcctctctttctttctcacagccaacttct

SEQ ID NO: 92155 - DNA, 589 bp, Homo sapiens
ctgaaatcaacagaagacaggcagagcaagatggaagaatagaagtctccacccatcaacctccacccgacccatgccccacaagaacaggaagttaataactatctacacagaaaaaaatacctttagaagagccaaaaatcaggtaggccctcgtagtacctggttttatcttcatattgctgaaagaagcactgaggagtcagaagaatagtcccgaatcaccacacatttaaaccagcccaagcctgaggggaatctctgattccagcagtgggaaattgagttcccccaaacctcgccactgtgggctacagtgctctgtgtctttaaatcagcttgaaagtccgtctaggccataaggactgcaacacttaggtgagtcctagtgctgaactaggcccagagacagtggattcggggggcacgtggactactgagacatcagccaagggagtggtggcatcacccctgccctaaccccaggctgcacagctcatggctccaaaagagacctcttccttcagtttgaagagaggagaagaaaaagtgggaagagcttcgtcttgcatcttggataccagctcag

SEQ ID NO: 92156 - DNA, 108 bp, Homo sapiens
tcattcactaaggaaagcccattctattttgttttccttgtttaaaaagtaataactttactttaatataactacaaaaaattatttttccaagagcaaaaacattag

SEQ ID NO: 92157 - DNA, 377 bp, Homo sapiens
ccagcaatccctccttggtctcctaaagtattggaattacagctgtgagccgctgcacctggcctcatacacttgttgagttcccctgaccaggactgggacttagctgagaggaatgagatgcccagggcaaaatgtaaggaggcgctgatgctcagggtcctgcggtgccacctgaagatgagcgcctcctgcattttccttccctaggtgcctcacctgactcaccctcatcctggccccacctccactctgaaccaggcactattctcaattctggggaagtaacagtgaaccaaacaggtagagctccctgcctacacggaccttccattatagaaggggaggcaggcagagctagtacccactgaggctcc

SEQ ID NO: 92158 - DNA, 156 bp, Homo sapiens
gtcagggtatagaattatttgaggatgctttaaaaatgaagattctgagcctcactttcaatctgctgtgtgagggcttccaagaatggtgaccagaaaactcagcatctttaacaagcacctgaaaaactgagaccattttcccacgtcttaatt

SEQ ID NO: 92159 - DNA, 433 bp, Homo sapiens
ggaacgaggagtaatgtgataagtgaagccagccctttcctggtcttcagggagtaattcttacatggcatacaattgtaacattcttataatacttgatacagtgttatggttgcacattcttgagtcatatgatctcagatggttaggaagtgaagtatttgtaagaacctcaagaatttagctttgagctcttcctgccacagatggcccttagagtttcacatcacttattgaaatgccatctgagtagacaaatatgtggaagcaagctttcatcttcagtttacattctccagttcttagaatcattccgtggcatgtccttttctgtattgcataaaaacacagcctagtatacatgagtataccatgcgctctaaaagtctaagtggattcagtgctttaagaagttaactaaagaaaatcccag

SEQ ID NO: 92160 - DNA, 324 bp, Homo sapiens
ctccaggtcacctttacagtgtcagttatataggaaaaagaatacaaataaattagggaagaggacctgtggatactgaggtcaaagacagagaggaagagggagatagagaatttgaatgagaaatatgaatgagatagagagcatacccttgtgaaagctcaccttttaataatctgacctactgttgtgatgacaaaagctccattcctcagcaccatggctcagtaaagccctttggacttatgctaccatatcaactctgttcctcactagagatagagacataggaggaacctgggggtagagagtacagacctgctt

SEQ ID NO: 92161 - DNA, 625 bp, Homo sapiens
  misc_feature (284)..(284): n is a, c, g, or t
gaagcacctacagatcaactggactggcctgaccaacctgctggatgcgccgggaatcaatgatgtgtcagacagcttactggaggacctcattgccacccacctggtgctgcccaaccgtgtgactgtgcctgtgaagaaggggctggatctgaccaacctgcgcttccctctgccctgtggggtgatcagagtgcactttgctgaggcagagcagctggccagaagggacactttctggggctcggaggcagtcagatccctacgccaaggtgagcattcgngcctacagcatttccggagtaggaccatctacaggaacctgaaccccacctggaacgaagtgtttgagttcatggtgtacgaagtccctggacaggacctggaggtagacctgtatgatgaggataccgacagggatgacttcctgggcagcctgcagatctgccttggagatgtcatgaccaacagagtggtggatgagtggtttgtcctgaatgacacaaccagcgggcggctgcacctgcggctggagtggctttcattgcttactgaccaagaagttctgactgaggaccatggtggcctttccactgccattctcgtggtcttcttggagagtgcc

SEQ ID NO: 92162 - DNA, 428 bp, Homo sapiens
gggccctgtacccttaggcaacacccatgctctccctaccaggtcggtgccctggttcatcccctgagcctctggaggcagagtactagggagctgggcttctcagtgaggggaaccttcccattcccccctcctcacagctcccacctcagaggatgctgggtaacaggagcacacacagagtgtcccccaacccccaccagctgagaaaaccttggtgaaggccagaggcccacgcaccctgggtgctcctgccccaagaggagagagagagagagagagttgggggagggattcctgcaggtgaacagatcaaattttggtcaaattccaataaattctcacttaattttaacatttaatgttgaaaaatcctaatggtgacctgattccctcttttgaattccagccctcccagataacctatc

SEQ ID NO: 92163 - DNA, 978 bp, Homo sapiens
gttaaattctgaatatcttcccactaaaagcacaacaaatctatttacagtgcctgaagcctgggagagccacatgagtaaaaactcgtacgtggtttagatttgttccatttacatttttcttgggatttgttgtgcttaaacctttgcagttcccacagatctgaaaagaaagcatttttcactgtaatacattaagagagagagaaaaaagtcatattgactattttacttgtttgaatcgctgtttttattacaatgacatgaaatacaacgtgtaaaagtctttaacctgtgttgggtaagggtaggactgtttcaccaccctgaatttgaaatttgaaaaagtcttaaagtggtagggtacttaaatttttaaaaaaatgaccatgggagcagtttttctctgttaaatcctggtaaacttcgggtttttgaagactttaaaagatgaaaatgaccttgagcatctttattcctttcctctgccccttaatgttgggatggggttcaggatgaaagggaggtgggattctaattcatgtgccagtgacaatcctgcatgcatatagaaatttttatttattgaatgtacacaagtaatgatggagtttgattatatggttcattttcatttatcctatgcagatcacaaagagtaaactgaaaggaacaaacgctaagtaaaataagggccagaaatctgtaaatttggtattagattaagaaaaaaagaattgccagttttttcctggactctttccttgcagaagcgattttcaggacaactcaagccaattaaaaaaaagaaaatcactttccctatctgtttggatgaagttaactagctagtcactaagtgaattttgaaacctcttacctaaatgatagctgctcttggtgtttctttatgctctacgtttggtcatgtaacatgcataatctctgttctctgaagttgattaaagttctaaactt

SEQ ID NO: 92164 - DNA, 528 bp, Homo sapiens
ctaagttttgcgggccaatgcttaatttagtgaacaaaatttgaccgaaaacagtattttctaaacatgttttgtaggaattccttatattctcctaatccctagggtctcgtcctgcccaagaaaagacaaccataaagagggaaggactaacaactcaagttaaaaatgaatcagatttttacttttggggtgaatgaatcacttccagaaacttggggtggtgcctctaaaatatgtacacgggttaaagcttctctcggtttgtttcactctcctccattccctcgcacactgatctcatgttctctctttgctggacgaattcaagttccccaggcgcacagtgtgacttccaattgcgggtcgggggcacacatgtgggcggcgtggcgtgcacacggtacttcgtcctgacacctgggcagacacctgggaggcacttccccgctagcccaaggttccctgcacgcccggagtccgctctgcggcggcttcccattcatgcttttgacaactctgcggccg

SEQ ID NO: 92165 - DNA, 503 bp, Homo sapiens
gctcagggcagggaagtggaaaacaggccagagcgtgatgaggctgcatgttctcatctgtcccctgagaccctggccgcacaaggcatctctccacactgaggccatgggctgctctctgggccttgagccgaagtcctgtcccgccttgggccagggtgggtgaggggcttccctcctttcaagtctggccagcgacagccggggaagcgacttggagagacgtctggctggccaggccccggggccgtaggtagcggattgataggtgccctctgcctggtcccgagagactccccctctcctcccacacctaggcctctgcacctagggctgtggaggagttaatctgccagtcacccccgttcctgtcctccaggctgggaagcgcagcccaggagttgcctccactctcctggcaggcttgctgggctgggtgggtgagtggggctgagtgtgttatggtggggggcgctgctgggtataggaggagggtgtgcttg

SEQ ID NO: 92166 - DNA, 118 bp, Homo sapiens
tgggagcctagaattttggcacatgctaggaaggatccccactaaaaaccttggacactgagactgggcccagtggctcatgcctgtaattccagcactttggtaggccaaggcagga

SEQ ID NO: 92167 - DNA, 667 bp, Homo sapiens
ctgcagagtgcccccaagcctgtgttcactgaggtctccactctgacaacactttcatctggaatcctgcctcctgcaggtgtgtgagtgggtcagggcttttctcttcatgggaccctaatcccttcccctcccagtttgggggaaaccaaccccagggattgagtcacttccagctgtgttcccacaggcccacaaccttcacacttgcagctctgggctccagcacctaattccttcagtctctgccttcaaaacacaaaggtctcaggttagacatacctcatacatggggaatgttcctctttttttctaaaaccacaacaaaaatctgtttataactacaaccaacatttattgtgtgcttactacttggagtcaggcactattgtagaagacagttaagtgtcttcaattcaatttacttaacaatccttatgggtataaacaggaataatatattcacacatactgtattattcctgtttataaggaaattggggctcataagattggatcaggagcctacagctagggagtggaagaatctgaatttgaacttagatctctttatttagtaaaccatggaaacctggctactgagttctcactttgccaacaacctgtttcatcttgcgtatatttcttgtttcttaaatatatttcc

SEQ ID NO: 92168 - DNA, 589 bp, Homo sapiens
gttatttgtactatcagttcatatgtcataaattggggaatacatttataacatcaaaatcattggtttataataatgtttttctcacacattactcatgtgaatacaaagcacgttaacacagttaattacagtaagccttggaagaagtgttacgtatgatgttcagttgcccctgtattcttcctttcgactcagtttggccacataccctttgtccagaagagagcttactgtgcagttctcccaggtcttggtacatattttctgcataactttgcagaccttttcacagaagagcaattgaatgagctcctgctgtacatatctaccagatctacctcaaaatgtaaagtcagtgaagagagcctgtcaaaaaatgtatactgattgataccatttctgtgaatttcagaaacatatataactgaattattaagaatatgtttcacatagtataagttcaatgaaaagtgtagcaggataagtacaattcagaatagtggttgccccatggttgggtactgaaggaggaatatgtgaggaaagagtgatacagttgagaaagaacacacagagcctttccaag

SEQ ID NO: 92169 - DNA, 452 bp, Homo sapiens
ttaagaaaattaaatgaagtgatatgatattatataaaactaatacacttatttgaaagagtagtaattagattcagatctttattctctaaaatcataaataaaagtataacgtacagaagagacaaagacttagagtaacaaagtaatggttggagattgtattgaaaggaggaacctctttttaatgagactcaaaaatacttgacatttcataagaaagtccccaaatgaaatctctgtaatatacaaatatggtatttagtttccaaatgttcaattattactacttattttgtacctagagggctgactttagcatctaaatgactctaagagacatgaaattaaaagaaatatgggccatgcgtatagtcatatcagcaaatcagaaagaaagaacttacaagagccccctggccttattctcatgaaaagtgataaaacagacc

SEQ ID NO: 92170 - DNA, 234 bp, Homo sapiens
aagtctaaggtctgacagaagcctttgcagagacacctgctgctttcaggactgcctgggactgagggaatcccccacacaaaaggcttctgttggatttctatgtgtagttgagaatgcttaaatgacaagggaagaaaaccacaagtgaaagggaaagacggactaggagaagtaaatggaaatacggttgacaaaaggctatgccagtgcaaaaagtgagtatgaagcacc

SEQ ID NO: 92171 - DNA, 206 bp, Homo sapiens
tgagtcttaccctgtcactcaggctggagcatagcaactctgtcatgcttcactgcagcctcaaactcctgggctcagacagtcttcccacctcaggctcctcagtacctaggactacagatgtatatcactatgcctagctaatttttgattttttgtagagatagggtctccctatgttgagtaggctggtcttgaactcttgg

SEQ ID NO: 92172 - DNA, 446 bp, Homo sapiens
ctcattaatatctattgtgtatttactctgtgctaggtgttgctctaagtgcttttgtatgtattgtttgtatttaattcttagacttaactaaataaggagggactactgttatccccattttacagatggaggaattctcataggtagcaagtggtagagccaagatttctcgggcagttattattgagcctgtgcacttaccgttattctaacaaattattgtggaaaatcaatcaaaatcttagatcaccacaacattatatacttctcttgagagattcctcaaacaatattggtgaccatgacaattaactcttttatttaagattaataaattgcaactttgctttagacacaagtaaggactcagtaataaatcatttacaactaacaagttcattttgttttagagtgagaaaaatataccatgcataaatggaaaa

SEQ ID NO: 92173 - DNA, 499 bp, Homo sapiens
gcacaccctccttcatccccaaccctttcactggaagttccctccacttccttgccctaactgaatgccagcaaatcccctgtgagcacttgccatcaagcagaaggtatttattttcacacattcttaaaagctcacacctggcatgtgaagtgggcaacttcctgctttccacaggcgctacacgcgtcattacctctccgttactcctctagaaggtttcactacttgagatccattccattaacatttaacactttgctccctcatcattactggcttttactgaactccttgtcatttcctttctgttattgatgttttaaagacctgggtcacgatctcctcatcacacttttcatgacaggatgttgagttattttaatatttacaagaacagtcctccgatactctgacttctcaaccccttgagccctgtctcactccaacaccattttgatgaatctctcaggatgcttttaattgctctttagcccag

SEQ ID NO: 92174 - DNA, 346 bp, Homo sapiens
aggcattcgtgggcctgagaaagctgaataccagatactgcagaaaagcatgccaagaagagatagcccattcatgctgcacagctctggagaggctggcagatggaggggtctgcttccaccacaggtgagtgtgagttggggggttaatcaaaatctctgtagcaagcaatgtaatcccaggtcccacccctattcctgaagccaactacctctcccactcaggaaaaaactggaggattatgacgtgaaaaactgacatggagcagctgctaatgtggggttagtaggtatcatgaaagagggctatgctgaaaacaagaaaattaagtgaaagtttacatat

SEQ ID NO: 92175 - DNA, 448 bp, Homo sapiens
ttcctcctggctctctccagggttccacccagaacttgtggctgcccagagctcagctccgaatcccaacctggaacctccgctgggggaatgagtcacagccccacccaggggagcgctccgcgtggctgctccataggacatgtattgtgcaccatttaagagacccctggcaacacagactcacttgcccctgcaaacactgttttggacctactacgaaccaggaattgtgccaaagagatcataacaagcccctttggcttgtcatatatgtaaggggagactgatccacataaatgcagtggtcccctctaagaagcaccctgttggagaagtgggggcccatattatgtctttctggagaggagataagaaattaaaccttatttccatgggtcaggtactagcctaggtgctgggatctttcacattagaagcctctctg

SEQ ID NO: 92176 - DNA, 163 bp, Homo sapiens
aggaggaagtgagtgggcaccacactggcaggctaaacatggctcctggcccagctctcaatcattttgaatcccctggaggcatttgctgcaagactgagcttctggtcactcccagttaagggtgctgtgcatttctggggtcccagttatcagcagcagt

SEQ ID NO: 92177 - DNA, 379 bp, Homo sapiens
aagatgtacaattttaaggacaatattttgtgcttggactagaattcagcttttgaggcacatgttaaataggcatattttaggacaaggtaaacgccacagaaattgattttttagtatcttttaaagatgcctttcagtgcaatctgaaatcattaaattttactgtactgaaacatattattttatgagtgatgtgcttaaaattacacatataaaactagaaatacatttgagaccatgcaaatataaggaaaaatagatttttgataggaatgttaatatagcagtttccactaactgaagacagagtcctctgtcatctgtcacattgttccaggtgctgtgtaaaccactgaagagtttataggctttttat

SEQ ID NO: 92178 - DNA, 220 bp, Homo sapiens
cttttaatatggttactgactaatatttcttcaattaaatacccccttttatctagtgatttatgccagtaccaacaataagataatttttggtatttgacttgtgctatatttgtttagaatataacttgcaaagccttcagcttcttgcatttccaggaagccattagattttatttagaagtgcctctgccactgtacataattgttgatcttattt

SEQ ID NO: 92179 - DNA, 246 bp, Homo sapiens
gcattcttgtgttataccagctaattgagatttgactgtggacttttggagtgattcagaaagaagggtaatgtcaaatgagtcattttcctctactccggtctcagtcttagctcttggccaagataacacatcctgacttgccttcataaaagctttatctgccctaagattctaatgaagcaggccaggtgcagtggctcacgcccgtaatcccggcactttgggaggccgaggccggtggat

SEQ ID NO: 92180 - DNA, 610 bp, Homo sapiens
  misc_feature (348)..(348): n is a, c, g, or t
  misc_feature (551)..(551): n is a, c, g, or t
tggaggatttggaaaactttttttttgtcaaggaccagatagtaaatattttagactttatgagtcagacagttgctgttgcaattatacaattccactgtggtagcttgaaagcagacctagacaatgtatgaatgagtattgctatgttctgataaaactgtatttgcacagataggtgtcacgggctgtagtctgctgatacctgctctagatcagccacctctaatgtggaatgtatgtacctagagaaaaatccaagatgggctacaaaaaagtagtggaactttatattattgacttattttaatatttctccttgttttatgatatgtgtataaatattantatggtagtctttggaatgcaataactaaatattaaaaaatagatggtattcaaaacaattttttactgttttttttactagtcttactattaaaattagagccaggttatatatatgaagagactgttctcagtccttttagatgggctttgatagtattttgctaattgaattacaacaaattttattggctgattatttngatgtagtagaagcttcaacatgctaattcatgaaagtatcagtctgcacttaaatggt

SEQ ID NO: 92181 - DNA, 353 bp, Homo sapiens
gcaacaaaaatctttaatttgactgtgtataattttttagtctttgatgataaattcagagttcagggatagtgttaatttgaacctaaaaaaaaaaagaaaaaaaaaaacccaaacaccaaaaactgaggttggtaaactacatatcaaaattcctagtacagtctgggagtatgtagactcaagatattctgcataaagatgatcataacttccgttagaaaggatatatgcagcctgggttaagaggaatattagttgggaggcgggagggatagcattaggagatatacctaatgttaaatgacgagttaatgggtgcagcacaccaacatggcacatgtatacatatg

SEQ ID NO: 92182 - DNA, 387 bp, Homo sapiens
taggcagctgactggttaactgcagtcaaggatataaacaatggcctcctctaaggaaaaaaattacattgctgacatccaaggccccatcatctctcaccaggctcttactggtttccgtgtctccagtgtctttctcacccttcttcccacaaatctgtcttccaccctgccagaataactctcagaatctcatacttggcatgatgctacttctcctcttaaaacaaaagaaaacaaactcagggtcccataagacttatggtaaggtccattcttcttagcaatataaccctcatctgtactttcagctttcttgccagctgcttctgtatcctatcctctgtcctggaatctcaccaggcatctcatttttatttattttcc

SEQ ID NO: 92183 - DNA, 540 bp, Homo sapiens
cacgctcagataattttgtatttttagtagagatggggtttctccatgttggtcaggctggtctcaaattcctgacctcaggtaatctgcccgcctcggcctcccaaagtgctggtattataggcgtgagccactgtacccggctggcagtggttttcttagcccacctctggtcccctccagtggtggctttccccaaggaggatcttttcttaactttgcataagtttgggacacagcattagggagtacagctaaattcttagagattagaatctcttctgagatgttcaagccagaaggaagaaggcgttaatcatgcagcatggcttttcctgaatgcaaagaccagcctgggcaacatgacacatgcaaggtcaacaaggatattcctggacttttgaagatgtccccctccttatcatggtgagattatggaaagcaatacctggactccagggccagctttgtctctaacttgcttcatggtcttggaaaactcaatccttctctctgggcctcagattcttcatttgtaac

SEQ ID NO: 92184 - DNA, 752 bp, Homo sapiens
tttcacaagatcatggagctttgccagaaagggacttcacaactgtcataacattttaatctctccaggcctgggacaaggtggaaacctacaggttcccaaggagattgttttcatcattagcatttcagccaaagccttaatgctgcaaaaagaaagcataatgtggagcaagagttcctgctttggcctattctgactctagctctccagggctctgatgaagtccattgtgatctagcattagaaaaaaaataaaaaataaaaaaaattttttaaaaagccttctctcttaagccttgctgctattcgtactggctcaaagtgcatggtttaatacttgtagctatgaatacttgcatatttccaaaggccttaccgtacacatttattgggaaaaatctctattttctcccaagtgggtttgaggtaaaaagaatccagtaaatagctacgcatttcattagactggatgagggtgtggattgctgtcattgtttgcccaagtgaactgctgctgtaaagaagccccttacaaaatgttacctgcgggactgctttcatgtcttcattaacaacagacacttggcattagtgaatcaaccactgtgttaattagaactcagacttgcagcctatcctcagctcatagaataaacactgttttcctttgacctaattacaagatgttcttaaacatcatcattttgtaaaagaaaccatgactacaaattgctttgtgaaccatgcac

SEQ ID NO: 92185 - DNA, 261 bp, Homo sapiens
caggctttctatgtgtcagggcagggccagatccagccccacatgcctacacttcatctgccccctctcaccctgtttaattgcaggcaagtagctttatttttttagggttccagctcctgcttctgcaaaaggcagggttgaaccagacgaccgacttccaagcttaagactgtacatttttcgaattgataatggggacccaaaatgccactatctttttctacttcttggcagccttgcgtacgtctgatgattgtc

SEQ ID NO: 92186 - DNA, 782 bp, Homo sapiens
atatatatatatatatatatatatgtcttaatgttaataacaattccctaggtcactagtaataagaagctatgggctttaaacttaaaaggtgctaaaccagtttaaatgtaaaacattctcataatagaattgcactgtatttcttttctactttgatgcttttccaaagtgctatagttcctgtgagatttgtgtcctgcacagaatcaaatgctaggtctttcacttttggatggctgagtaccataaaacatgatttatttggtaacaaaaatgtttccaggagtttaaaaagggaccactactcagagctaaaaaagttctaacagtcactttttaaaaaagctagtttatcatttgtttataaagaaaaacacaactctgtcctacttcctctaataaaaatggaaaatattaagatgagctgtgtgcttataaagaggtgctacacaagtcatcttacgtttctagtcaacacaaacattgcttcagtgacacttaatattcaatacatgatgcattactcttagcatttttgcatttactctccgcatataacaaggtcagatatcaaaacagtcctgatcttagacaactcactaccaatatttaaagctgtttcctcctaggactacagttcctaaactatgcacagggagcaaagtggtattcccttaggataaacttggtcaaggctcagataaccctgagatgaacttagcaaagtccttgtaaagaaatcttcagatgggaaactccacctatgtgaattttaaagc

SEQ ID NO: 92187 - DNA, 793 bp, Homo sapiens
cttataacttcagctcccaataactcactctcagccttttccattgtgacgctgcagaaaactatgtgttgcttcactaatgccatatctcttttaatgccatagaaggaaggaaaatttaacagggagagaggtcatactttttgaagtataagtttatgtttttttccagggcttctatatcattagtgggagattgaaccacttatatcataaataaaatatcacttataccttatatttgaataggagtttatagtttaagagctacataaaatcacaaatggtgtggtctcagtctgcaggtgtggaaatgagaggtaaatgacctggccaaggtcacacagttaacatgtaaggggatggatctgggactcgaacccatgagctcaggtttagggttgttggttttttattttctgactgtttcagtaattcttagactttcacagcgaaagactcctgatggcagaagagagtacacaaatgtctcttgggaatacagaaagcaagcttaaagagataacagcaaacataaaaatgtctgaactattttaaaaattcatgtaaatataaccctatgtttcagcatatcctgatatatttaacacaacaaagcttccttcttttgttctagactgcatttatgtacatcttctcattctatgaagtgaccaagagttgtgatttggctggttcattattgtcctttagtactagccaagaactatttaagatcagaaattaatgtttcttcctagaaaatcaagaagagagagacagacagatgaga

SEQ ID NO: 92188 - DNA, 356 bp, Homo sapiens
tctgtgtcttggatgctgggtgtgcttggtggtctgtctgtctgtctgtgccttggatgctggatctgtttggtggtctgtctgtgtcttggatgcttggtctgcttggtggtctgtctgtctgtgtcttggatgttggatctgtttggtggtctgtctgtctgtgtctcagatgctgggtctgcttggtggtctgtctgtctgtgtcttggatgctgggtctgcttggtggtctgtctgtctgtgccttggatactggatctgtttagtggtctgtctgtctgtctgtgtcttggatgctgggtgtgcttggtggtctgtctgtctgtctgtctgtgccttggatgctggatctg

SEQ ID NO: 92189 - DNA, 581 bp, Homo sapiens
tggggcagcagtaatttttgattgggagtttgcagacctttgtgaagcctcgggctgttgcctattctgacaagttttcacagattgcaggtgagagatcagagggaagtgagcgggtagtgttttgagaaagtccaggaaggggaatttccttctaaccattggatagacgtgagcattgtaagtcgtattgttgcctatctcaggtccttagagactgaagaagtatagggtgggcttgtttgcttgtagtgagttatttgaagaaatagagtatttcaggtatagacttgaagtaaaggtacatgagtcactagggattttaaaaaatattccttagacgtaactagatatttaaagtaaacccttcctctgtgatttcaggtcaacaacgagataatcactgaagttcctttgttctgtgaaattttgtgacttttatttttttgaacaaccattacatgcactgattgtttcttgctgttgtacaagcactgttgttagtggaggggagctaagggtttactctactgcataacacatttgctctcttatgtctttcacagagacccatgggggaa

SEQ ID NO: 92190 - DNA, 642 bp, Homo sapiens
tgaaggttttctaaaaagaaaatgggattggattggtcagggctacgtactccgatttgtgaggcagtggtgtctttgtaggcttggctgttaatgaggtggtttatactctacaaggcatgtgaaattatttgagggagagaggagaatgtgtttttctaacccttactatgtcctaaacacagagggtaatcaataaccaactgttgaggatgtagtttttcttaacactaaatcattccctgagagaagtccgtaagcttgactgattttaactgcctgtgagttggaaatctttgataaatgctctgagggataggaagtcagtctgggatgatacagggcatgggatctcaccatcgggagagtggtcccattcgataatgggaaaaactcatgttggatggaatggaaatgttcccagtcaagataccctcatgcccagagccaggagaaactttagaccaacctccgtcggcttcagtttctccttcctcagtttcttgatgctcctccccgagccccctcccctatcacgtatgttttgcgggttgttctgttgtttgtctttgaaaagattgatttatacatttgtacagaaaatcccagagccttttcctcttaatgctataaagttgctat

SEQ ID NO: 92191 - DNA, 422 bp, Homo sapiens
aattattttaataattaatgatgataatgagtccgaattttaagtatgaaaattattatataaagagtaaaaattacaggcatagattgagaattaatgttgagagagtgtgattgctagtaattctggggaatccattgtattctttgtgggactactttcagtgacattatatcatcatcattaagcaaatattcaggcccaggagatgaagagattaagtcttgacctcagttggttcctatcagggaggaaggatagcttactaatgtgctggcagcgtcacttccggcagcagtgactctggcagagctagcgcaagaacatcttgctttttctacagaccttgttttagagagaggatttgtttagttttacagaagtcccatcaggctgcagttaacagtaccaaggaattacca

SEQ ID NO: 92192 - DNA, 437 bp, Homo sapiens
tgggtaaagaaaaggattaagtcagggattccaagtttttaatacaagtactgcattaatatcctaaaaatttatatgtagccctgaagaagatacttaactcctgcagcttcagggctcaaaatgctgaaaagaaatcatagcatctcatcccataactggctgaattacaacaaaaattaaattcccaggcttgcaggatgcctacttttaaagtgggggtattcattcagaaaacattggatattaaaaagttaaaatgagggccaggtgcggtggctcacacctgtaatcccagcattttgggaggctgaggtgggaggatcacctgaggttgggagttcgagaccagcctggccaacatggagaaaccccttctctactaaaaatacaaaattagctgggtgtagtggtgcatgtctgtaatcccagctact

SEQ ID NO: 92193 - DNA, 394 bp, Homo sapiens
actcaaattgaggaaaacagtttagtagttaccttagcccattaatgaatacctccctcctcccagtgaaattactgaagaaaaaagtatgaaatcagattatgctaataaatataatttctacattatcaagtaatgaggcggttaaatctcaccaatatttgagaaaacttggtaatagtttttattttaagatttttttccatattttgaaaaggcttgaaatcaactctaagtaatactattccaactttcaaagtacacatctccagaaatggaaaagattctaccaagcactgacagtagatagtggcttcttcattccatgggatattttagaatgattttaactatagtctcaatatcactatcactttgccttgtgaaggctctg

SEQ ID NO: 92194 - DNA, 441 bp, Homo sapiens
ttttaacaaatatagctgtttttaacacttatattcaacttaatggctctgcttgtataagttaggctttatatacattggcggttttatttatgtctgtttaacttaggactgtgtacctaagtacagtccatcctcattattcttggattctgtatttgtgaactgcgtacttgctttatttgtaatcccccaaacagtactctcagagccttttggtcatttctggacatgctcagggtggtgaaaaatttgacttgcctgacgagcatgtttctagttgaggttgaacaaggtgttgctctgcctttttttttttttaagctctcgcactgcaaacaagtgtccttttcatggtctattcagtgccacatgttttccatttttgtgctttttctggtgactttgctgtttaaaatggcccctaagcgtagtgctgac

SEQ ID NO: 92195 - DNA, 397 bp, Homo sapiens
tggagaataaacaagtctaaactgaacccactctctccctcagcactgtagggtccctcctgatcagcatggtgcctgacacatagtaggggctcgaatatttcctgcaagaatgaacaaagtgtccagcatccctaacacttctgatattcctcgaatgcataggcgtagcagaatatccagaaagctttcaagagctggcattttctgtatcccccaacatactcccaccctccagtgctgggtttagaatcagctagaccggtctggctctgccccttcctcgctgcgttgcttcacctctctgagcctcagtttccttttctattccatacagataatcaggactctctgaggaagagaacaacagggacgccctcccggaggagttgggtgg

SEQ ID NO: 92196 - DNA, 465 bp, Homo sapiens
ctatttctgccattgccaccatcgttctccctgtctcccaaactaaaaacctcaggcattcctgactcttacttcacccctaggccccacacccatctcggcagctcatcttcccatcttagtggtatctcctgattacagtgtggtcaaacataagatccaagataaaagaaccagcaggctttagagttggacagacctgagctgcagtccccattccatcatgggtcaccatcacctcggatcatctgcctgactcaaatttcttgttcagtaaatggggactcgcaattccctcacaggtgactccagtaattgatcacatttaacagcatgtttgcagcacccaccacaaggcctggtatgctgtgtgggcaggaacaagcctcttgcccccagccaggcaactcagagcaaccagggagtccctctgaaatgacttcatcacacttcatcactcttcaa

SEQ ID NO: 92197 - DNA, 209 bp, Homo sapiens
tgggtagatcacttgagtccaggaatttgagaccagcctgggcaacatggcgagaccttgtctctgctaaaaagttagctgagcatggtggtgcttgtccatagtcccagctacctgggaggctgaggtgggaggatagcttaagcccaggaggttgaggctgcagtgatccaagatcatgctgctatactccagccttggctacagag

SEQ ID NO: 92198 - DNA, 461 bp, Homo sapiens
tttaggttagagctctaacaaccaaattgcaaagagatatttcagtcttttgagaaatgtcatacccaagtgagaataagccattatgaattttgacattttctgaattattactttatgtactattttgtatgttagagccttatattcagatataatttaaatgtcaaccaaaacaagtgttttctgctatcaatattaaaacattttgatgtgcttggagcatttgctttcagttaggcttctaaccttgccagggtaccataacagttctgtcttctccatggtctgttgcaaaagttaccagatcataacctaatcacggggggccagaggggagtgatgtggttagaatttgtgtccccacccaaatctcatcttgaattgtgatccccaggtgttgagggacagacctggtgtgaggtgattggatcatgggggcagatcccccccatgctgtt

SEQ ID NO: 92199 - DNA, 464 bp, Homo sapiens
tgtgttcagctatctagaagctccccaaacccagttcttttggggttttatggaagcttcattatgtaggtacgattgattaagtcatttgccattgatgaccagcttaactctcagttcttctcccttcccagagttttcaggggtggtgctgaaagtcctaatgttctagtcaggttttggtctttttttatgaccagcccccatcctgatgttactgaggggctcccagccatcagtcaactcatgcatatgaaaagataccacaatagggataaagaccaaatatatattttacaatatcacaatgttattgcacagtggagtaaatatcattcttattataaagaggcagagagctgaattgcattcctgccctagtgttttgtgaaagatagaacttataggaatgaagttgaatctttgaggaaatatttaagaaaagtattgaaggtatggcttgg

SEQ ID NO: 92200 - DNA, 127 bp, Homo sapiens
taatgaatatataattattaatatatatttgcatggacagtagagttttcactttttttagttcttctgagagtaaatgtaatgtgttaagatttttgtttcttcctttaggctggctttttgataa

SEQ ID NO: 92201 - DNA, 472 bp, Homo sapiens
acacacatacacgtgcatgcacgtctcagatgtaaaaagcattttctaaccagccacctatattccaaatgcccctcaaaagatagctgtgcaatatcaattgcagtcacttgggaatggcaacagaggcccacaacatatgaagttgctagtgatgctgtggaagtattatacaaatctgaaccgtgtgggcaaggaaggtgtaacacgcaggagtcaaacacttagctgaccagtaggaggacaagtaagagtttccttcttgaagaatcttttgctctcacatcttttcctcagtagagtattctccactgttacaaatgcaggttcttgagccagactacctaggtttgaatcctggctccacctctaactagctggatgaccctaggcaacctaggcaagttacttaacctccctgggccttgatttcatcatctgaacattggaaacaataccaccacctcatagg

SEQ ID NO: 92202 - DNA, 418 bp, Homo sapiens
aaacaaaatcgtattttttttccagtggattttgttcattgtatcttgcaaaatttagaagtcttgggaaatattcaaattcaattgtaaagaatgaacatcattaagtgcttaagctgttagaatgtgcttttaactccagttaaagtgttcttgggatgaattttgaggctatctgcaatatatttaaatatatgaaaaggaagtcatttttaagagttaatatttcttacaattttctctttgatttgctctcagtggacctttcttcaagtgcaatgaattattgggcaatatttcagagatagaagatatactaataaacaattgtgattcctccatcaccacattcttcaaattcctgaataaacaattttccagtataagctaaaacacaggcttaacagaaataactctt

SEQ ID NO: 92203 - DNA, 424 bp, Homo sapiens
gtaaactgttactagaatttgaactccttgacaggtgggatgttgaatgcctcatctctgctgtcccccactgtgaaaagcacagtacaaaaccttggacaaggcaggcttcagtaattatgtcctataatggaaagtgaagttgtaccaggtgggctccaagttaaggatttatctgtattagccttggctcttaactacttacttgtttcaaaggatattatgaaaaagaaagaattgtgaaggttaaatccaaatgatgcaatttaaaaattcaagcccagctaggcatggtggctcatgcttataatcccagtgctttggcaggccaaggtgggaggatcttgagaccaagagttcaagaccagcctggacaacatagccagacccctatttcttaaaacaaaaacaaaaaaaccacaag

SEQ ID NO: 92204 - DNA, 937 bp, Homo sapiens
gaatctgaagtgggagttgggcttcctgtctgcaaagtccaggctgggagatgaaatggatgagtgcatggcagaaaatatcatcacatactgaagaagctgactgctaaacttagcctaacatgttttaaattgtaacttttccagattctctttcatagcagaatgtcactgacagtccacagatattgtctccaaaatggcaattaatactgaatacagcaattctagcctctttcaaggagaaccatctgacccagaagctgaaaagaatttacttaagaaggcaccaatttaataagcatccatgattttacatttaattaactttttgagaaaattgtgctttccaaaatctagttaaacaaaagaggtagttaaatctctttaatgcctcaacatcaaattccaatggagtatgatttttttttaaagtttcaggatttttttttctgagaaatatcaaactgcttttattatccgtctcggcaacctataatatataaggaaacagatcaaactaataatcttaaacatgtcttaaaaatgtaaatttctagtcttgatttctgacctccagcttaatgaattattatgccttgcttgtattttcaaatccaaaccatttagtagtttataactggatttttataaaatttgacattttatttatttatttatttaagacagagtctcttgctctacccaggctggagtgcagtggcatgatctcagtttactgcagcctctgcctcccgggttccagtgattctcctgcctcagcctcccaagtagctgggattacaggtgtgtgccaccatgcctggcaaatttttgtatttttaatagagattgggtttcgccatcttggccaggctggtctccaactcctggcctcaagtgatctgcctaccctggcctcccaaagtgcgggcgc

SEQ ID NO: 92205 - DNA, 293 bp, Homo sapiens
gagattgcaccactgcactccagcctgggtgacagagcgagagtccgcttgaaaaaaaaaaaaaagagggtaaccaattgtctagaattgcatgcctagcaaaaatggtcttcaaaattaaaagggaaataaaggcatttcaggacaaaaagaatttatcacaagtaggactgcattaaaaaaatgctaaagacatcttcaggcatgagccactgtgcccagcctagaagcaacttttgaaaagataatagctgaggactttcaaaactggtgaaaagcattgtcacagttta

SEQ ID NO: 92206 - DNA, 382 bp, Homo sapiens
agatttcaggtcgtgcagcaggtgatgtctatgccagttgcagaaaagagcaggaggagaaaacgtgttgaaagagaaaggggaaggtggtgcatccagtttggggcatgaggcattagacgtgcccaggaactttctggggaagaatggcaaggatctggggcagtcatgactgggtcacagtcagcgaggagataggtatggaggctgatgagggaagaggatgctcacagggcgggaaaattgaggaacatcagtcatccaggttgataaaagaagaggagcttgcaaaggagaagagaggaaggaaggaaggaaacatgggcaggggggtcatgggagacacagagggacaatgtcccaggatgcatgtgtgctcacg

SEQ ID NO: 92207 - DNA, 694 bp, Homo sapiens
cggaagggaagacaagtatcaacaccactggcatcatttccaaactgatcttatgttgaataatttccaccacattgaagtacctttcgactctatccagtttttgggttttgttttttttaattcatcaagcctttcgttttcaaaccaccatttgtcagccttgaggtagagagacatatagatttgaaaatactttcttaagagatcatgtaactatataactctgaatttaaaaattgaggggggagggataatttcaacccactgcctcttaccagaaacatttttttaaatctgtaactgctttagtgttaacagggtgcaaggtggtttttgtcccgtattgttcttaaaaggttctcatttattgtgattgtattgtactgtatgagaacaaatcataaattgccttgtattgtttataatagaccataccacgtactacttcagtttttatgttccaagtttttcagtgatgcatgttaacagttaggtcctaaaattctgtggtgctaattctcccatacccaatggtgcttttgtggatgctaactgcacacatgctgaacaaagcttgaagtttaaaactttcctcccttcctctgtttatatgaagtaaaatgaaataacttgaatttgtctcaaagtatcactgacaatctaataaacttgtttatatgtgtgaaaagtt

SEQ ID NO: 92208 - DNA, 420 bp, Homo sapiens
cttcaactctcccacctcttccccattaaaagtcactgcaattcctaggaagcagtcttctcttatccctttgccttcgtggcagaccctgtgccatgctttaaggaccacaaagctacgtgatgaaacagacaggagaaagggaggatgggactatgtttactgtttgtactcagagaagtgttcaaacaagaaaagggaggatcccttcctgtgagtgttattttatcttaaatacctttccagttgtcatctttggactgttctcagacactgaaagacttgagctccttcctgcatgccacagaagtataggaacattcttcgcgttgcacttatggctgaactgcacaggctaaattatagcccgctctactagccacacaatccaatctcgtatttataattctcttctatctc

SEQ ID NO: 92209 - DNA, 518 bp, Homo sapiens
gtgagttccatgacccccctctgtgtgcagcctcaggacactgcttcctgcatccctgcagctccagctccagctccagctccagccatgactgaaagatgcacaggtacagcttgggtcactgctacagagggtgccgcctagaagccttggtaacttcctcatagtgttaagccactggtggacgcagcatgagactagaggcttgggaaccttgctatagattttggaagatatatggaaatgactggctgtccaggcaaaagcatcccaaaaaggcagagccttatatgaaacttctactagggcaacacagaaggaaaatatggtgttggagcccccacactggaggccaccatcatgcagacccgagatgtgggaccagtccaagatccggggtaacagggtgaaacccggtctctactaaaagcacaaaaaactagctgagggtgggggggggacctgtagtcccagctactcagggggctgaggcaggagaatggtgtgaacccaggagg

SEQ ID NO: 92210 - DNA, 697 bp, Homo sapiens
gtgagttccatgacccccctctgtgtgcagcctcaggacactgcttcctgcatccctgcagctccagctccagctccagctccagccatgactgaaagatgcacaggtacagcttgggtcactgctacagagggtgccgcctagaagccttggtaacttcctcatagtgttaagccactggtggacgcagcatgagactagaggcttgggaaccttgctatagattttggaagatatatggaaatgactggctgtccaggcaaaagcatcccaaaaaggcagagccttatatgaaacttctactagggcaacacagaaggaaaatatggtgttggagcccccacactggaggccaccatcatgcagacccgagattcatagaccccccaacaacttgtattctcagtggggaaaagtcacaggcactcaacaccagccgagcccctgagggcagccgtggggcataaaccctgcaaagccacaggtgccaagctgcccaaggccttgtgagcctagccctcacacccctgtgccctggatgtgggacaaggtttcaaaaaggctgattttggagctgtaggatggaatgactggccttctgggtttggagtttcatggggccgggcctcagtgcatgggcggtgtccaacctctggtgctgaatcagccaagagatccaagcctgcttggctgcctc

SEQ ID NO: 92211 - DNA, 286 bp, Homo sapiens
atatactcatactgggtaaccaacctgcttggtttgtccagaactttcaatgctaaaaccgggaaatcctgagcaaaacaggacaagttagacattcttacaattgaggactgtaaaactgtaaaggaggaatgagcactatctctttatactagtgtggagtgatcatcagaatacatagttacatttaaaaaatgcaagctagaggaaagtatttagagtgtactactgtgtaagtaaagggtgaatatgaaacatacacagacacacacacctgcttatatta

SEQ ID NO: 92212 - DNA, 610 bp, Homo sapiens
cagatacatttgcttctggcttaaaatcactggctgtaggaggaaactccagcagagggcatcgtaaggatttcatagtgtctatggtcatcttggtaattcctcagataattcctggcaattctattaggtcttgaacttcacttacttcttacatgtttaataaaaagaagttcaaaacattgccatggctgttgaattcccacaggcttgtcttccctttaaaattcatcacatggtttgtactcttttgcagatataatacgtaagtttgcaggtggatgctttcagccaataagttcaaaagtactgctacaagggccaggcatggtggctcacaccagtaatcccaaccctttgggaggccaaagcaggtggatcacggtatcaggaaactgagaccatcctagccaacatggtgaaaccccatctgtactaaaaatacaaaaattagctgagtgtggtagtgtgtgcctgtcgtcccagctactcaggaggccgaggcaggaggattgcttgaacccgggaggcagaggttgcagtgagctgagattgcgccattgcagcacagcctggttacagagtgagattccgtcccccaccgccaaaa

SEQ ID NO: 92213 - DNA, 589 bp, Homo sapiens
agatattgtaatacaatattacaaaaggtattacttttgtaatacccaaaggccaagtaattttcctttctatactgattgagacttgagtgattttttttgaaaatgaaaaattcttttagatttgataaatagtgaaaaagctgaaagaaatttttgttttccttggcattatatgcattcgcctcttatgagaagaaaatttaaatttcacagaaaaaaaagttacatgtgacctataacttgttggcctgtgttaacttttttctaggaaggattgaaaaaccaactagaaacttgacagctgggcgtggtggctcatgcctgtaatcccagccctttgggaggctgaggcaggcagatcacttgaggtcaggagttcgagaccagcctggccaatatggtgagaccctgtctctactaaaaatacaaaaactaaccaggtgtggtggcatgcacctgtaatcccaggtacttgggaggctgaggcacagaatcacttgaacacaggaggcggaagttgcagtgagccaagattgcaccattgcattccagcctggatgacagagcgagactcttgtctccaaaa

SEQ ID NO: 92214 - DNA, 548 bp, Homo sapiens
ggaaaagaggaggattctgggtacaggaacagttgcaggggagggcatggaatgatttgaaagaacatagggggtgctagggacaataaagacaaactccatctccactaaacttgactggggactggcctcttcatcccagtttaacaacgggatagatggttgtgaagacagactctggaatcaggccctggaatttgaattccagtgtgaatgtctcctcaatgtgtggcccttctaggctttggtattcccaattacacagtgaggatgatggtggactctgactctccaggtagttgagaggattaaagaagaatgtgtgtggagcagcagagtggtgctgagcacagcaggctagcggtggacactggagatacggcacaagggctgggagtgaaaatgcctgggattgagcctggcttttcccctagctctgtgaccttattcaagacatttgaccaccttcagcctcagggcctccatctgtgcaatgggcgcattcgttcacagattactgagtgaagtgctggcaggcttcccaggct

SEQ ID NO: 92215 - DNA, 318 bp, Homo sapiens
gatctctaatttcgtatgtctgataagtagacacacattccaataactcccgagacatcctttcagtgattaatgacagactacaactatatctggaattagtgttttcaatggaagtaaatgctgcttattctgaagaaatgtaactgggatacttctgataaaagatgtttcctaagtttcccatttgtatttgaaaagcacatgatcgtgaccatcattgtatacttctctttaacccatgtttctcctccagcaaaacaatcacacatttgaaaatcccacatagtttatggcatctccatgtctctaaaatga

SEQ ID NO: 92216 - DNA, 478 bp, Homo sapiens
cgagagttgagaacaagcaagtggaatgatccaatttcctttatgaaaggatcagtcttatttttctgcggagaacagactgcagtaacataaaaacagaaatggttaacgggctactgcaatagtccagaagagaggctagcttggactaggggagtgaaatgtacagtagggggagtgaaatgtacagtaggggaagtgaaaagtggtcatattcaggatttattttagaatgcaaagtaaataggatttgctaatgaattatatgtgcaatatgacagcagactttctgtatgctttgctgccttagcaactaggtgaatgatagtgaccatttactgaaaagggaaacacaagaaaagtgcaggttgagaggaaggtacgtagggaggggatcagaagttgtttgaggagtatccaattttattcacctaacagacatccaactggagataacaagtgataaggtatatttaaa

SEQ ID NO: 92217 - DNA, 440 bp, Homo sapiens
gaactagcatttaagctatttcattatggggtgaaaaaaatcatcatttagaaataaaagtaccaattagtaacaaattatgtacaagtcactctagcacagtgtatttcaatcacttcagtaatttttagcctcccaaaaaaaagtgtcagaaatgaggcatgaaaagctattaaatgaatcattcacacgttgaatagatgttgtcgtcagtttgttctctcaatggaaataatgaacaactgatttatttataactggtcattatgataatacaccttcatgttccacccttttcaatatattatggatatgttataactgtcttattttatagctgatctaaaatcatatgcttccattaaaatttcttcttttccaggctttcccttaattttaatgttcctttggcttggggtgtaattaaaatgtttttactg

SEQ ID NO: 92218 - DNA, 184 bp, Homo sapiens
tattcagaagaaataagtaatgtctccttttttctactttaggaaatttctagaaaatctatcattagaaacatcacaaaataattatttacttctgtaaatattacttaaccctttagaagggaaatatatactttttcttcatacctaggaccacatttacaagatgtttccatataaccaa

SEQ ID NO: 92219 - DNA, 759 bp, Homo sapiens
gggggtccccagagctgtgattggtgttggcccgagggtcacccctaaggattggacaccttgggtctgggtgggcagacagccttggaacctcgggatagctgaacttggagctgacccagaaggcgttttctcagaaagcttatcgcttctaagggtagaatcccatattctggaacaacggggacagcagagaacttgatcttacatcagagtcggcccagtctgcctttgtgaaggactccccagtgtgaacccggaaacagacaacactgtgaccctaggggagccctgggtgccgggtggggcgggcatggggctcagagaacgcggggagccctgggtgccgcgtggggttcagagtacgtgagaacagaacgtgggagaggaagaaaaaggcaacggcagagggggcctctgtggggcgggagaggagcatggaagggcctgagctcagagagagaggggccaggacagagggggcctctgtggggcgggagaggagcatggaagggcctgagctcagagagagaggggccaggatgcacaagggaaatggaggggcttccaggggcagacagctagctactcctctcccattttttcaggtttatgtggacgtgaggtgggcagagtcaggcatttctgcaggtgtctgaacagcggcttttcctgttccatgggggctgcagaatagtgctcccttcttcatccagccagctgttctgaaactttgttgctcaaaatgtaacgtctccg

SEQ ID NO: 92220 - DNA, 604 bp, Homo sapiens
gacagagttttactctgttgcccaggctggagtacagtggaacgatctcagctcactgcaacccctgcctcctgggttcaagcgattctcgtgcctcagccccccaagtacccgggattacaccatgcctgactaagttttctattttttttagttgagactgggtttcactgtgttggccaggctagtctcgaactcctgacctcaagtgatccacctgcctcggcctcccaaagtgctggaattgcaggcatgagccaccacgcccagccaggatattgatttgatgacaaacttatcatcgttcagtgatgtacctccgtgtcaaacttagatatccaagataggttattcttttttttcttgagacagaatttcactcttgttgcccaggatggagtgcaatggcacgatcttggttcaccacaacctccgcttcccaggttcaagcgattcacctgcctcagcctcctgagtagctgggattacaggcacgtgccaccatgccggctaattttgtatttttagtagagacagggttttactatgctggccaggctggtctcgaactcctgacctcaagtgatccacccacctcagcctc

SEQ ID NO: 92221 - DNA, 629 bp, Homo sapiens
atgtgtgcggtgttctagaggatcccgacgaggggtgtccagccccttgggtctttggtgtcttccctgaggttgaggacgtggcctgtacctgctcctgtcccccgtaggctgggctgctctctgctgggcaccaggcctcacctctttgctgtgggtgggaagcgtcgagtggtcacacgatctggcttggccacctggtgttgccatgcaggatgtggttgctccattttccttggacgacactgggtggtggcagctacacccgacactgtcctctcatcctggtttgtcctgcctggaggggctgcgtgaaaccacacgagaggctcaggtggtgtcatcactccgagccacgggtggtggaagctgcacccccacactgtcctctgcgtgaaaccacacgagaggctcaggaggtgtcatcactccgagccacatgctcgcccctgggtttctttcccaggcaatgagatgaggttggggttcagcctcatttcctctccccattctgtggatttgtgaagccatggaaggccctcgccctgtgactctgcccccaggatccccactgactgcagaggagggaagtcgcctgatgctttccaagtgaacaaagatgacaacac

SEQ ID NO: 92222 - DNA, 257 bp, Homo sapiens
accccaagtgtacatagatgggtgaatggtatgatggctaattttatatgagactgggaaataaggtaaccagatatttgattaaatattattctgggtgtgactgtgaggatgtttctggataggattaacatctgaatgggtagacttagtaaagcagattccctcctcaatttgtatgagcctcatccaactggatgaaagtgtgcacagagcaacaacgctgagtaaaggagaattcactctctctgccgatc

SEQ ID NO: 92223 - DNA, 907 bp, Homo sapiens
agaaaatactactttttaataaataggaactttatatatataagtggaagtattttacttcagacttagaaacatgttttaaatagcctttttgttaccaacacactattttttgtctacatgaattggttagttataaaatcattttagcatcattagccttgcttgtcttttccagcttatcttttgctgcttaatattgaactctaggaatcttttatccagtttttgaagtgtcagtattaaacagattagtaaattcacattcatgaagttttactgtatatttaatgaaatggctatacacacaaacagtgcatgtttaacttttttttccccttctactagaaatgttttaaccattcagtcagaatttgttttgtagcaacagttggcctcagaatatattttttttctcagaagaggttgagctgctttcagagattttgttcatcttctatagagtgttagaccacttcagtttcacgttttctgatgttgtccatcatacttctaagagggttgggttcacttttcaagtctttcacggttttgttttttacacagcagcagcagtcaagcacttcataaaggaaagccagcaccactaaagataccactgtaaatataaataaaagcaggatgacaaagcaggcagtgttccagttgtcatggaaagggtaaattttttgaacttgaaaaccaaggtactgataaacagaggtagtggtttcattccagtggctggaagccattcttagagattccacttgctcttttgaatctataaaaaaggtagaaaatgaatttatgtagcaaactacagatctgttaattcaaatctcagtactaagatttcttagtaaatttgtataggcaacatgaatcttccttaattaatgcctaa

SEQ ID NO: 92224 - DNA, 2939 bp, Homo sapiens
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92225 - DNA, 2733 bp, Homo sapiens
  misc_feature (12)..(13): n is a, c, g, or t
aaataggctagnnacgaggctggggtgcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92226 - DNA, 2172 bp, Homo sapiens
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagggaagtggttcagtacaagttgtggtccatactatgtctatatcgtttgtcgaaagtagtcacttaggttgccctgtttttgtttttcaccatgaaaaagtggcagttaaaggaacagggttttgtggggaaaggaaggtttggggtaaaaagggggaaaaaaaaagggggatgggggatgttttacgagtgtaggttac

SEQ ID NO: 92227 - DNA, 1930 bp, Homo sapiens
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaatgttgtaccaagtgctgtcttgaagactgctgatgttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcattaagcttgttccactgcaaataaagccttttaaatcagcggaaagtaatacat

SEQ ID NO: 92228 - DNA, 2727 bp, Homo sapiens
aaggaagagagaacacgaggagcccagttactcggccgaggcataatcgagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92229 - DNA, 1191 bp, Homo sapiens
  misc_feature (1059)..(1059): n is a, c, g, or t
  misc_feature (1089)..(1089): n is a, c, g, or t
  misc_feature (1108)..(1109): n is a, c, g, or t
  misc_feature (1113)..(1113): n is a, c, g, or t
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgaggggctcgaatggttcgngactcttggaatggccgaaaaaaaagcggnctatttcttgagaatgggnnaggnggggcgtgaaaggggggggacaaggggacaaagtgggcggcacacacaggttggtcggagaaagggggaactctttgt

SEQ ID NO: 92230 - DNA, 2710 bp, Homo sapiens
  misc_feature (112)..(112): n is a, c, g, or t
  misc_feature (120)..(120): n is a, c, g, or t
  misc_feature (141)..(142): n is a, c, g, or t
tttaaggagctgggaggcttttggagactgctaacacggtgtccgtgtaattacgctacgcgctgtccgattcgagcgagtaatgaccgaagaagattgactgaagaaggangagaaggncatccgagctctggatgaggnngatatggcttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92231 - DNA, 3536 bp, Homo sapiens
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtggggtaagatttctatttacaataaatacttttctttcactaaggatactgtctcacattcatatccttggctttgtagtgaataaatggactgagttccttggaataccaaaggatgatctagtaatgtactatagttgaaaattctgtcttctgcatctgcttcctaacttcccatcggcttcgctgactcccctactcccactgttgtttattatgaatggcttcaaatttcagagttgaggttaccagtccatttaaggtaacatggtataggttgggggagtacttgctttaggatagttgtgatgctaagtgtgttaatgtctatagaatacataacaactcacttagtaaattaaaaaaaaatctcccctccctcctcaaaggtttgattgctgttggataggttgtttgcgacattagacatgtagtttagtatcctcagatttcatgctctctttatttctctttatataattagggactctgtctctctcttgttttcttaaagtatggttttggggataaaggactaaacataaaagcactttgaaagcttaaagaatgtattaatgactatcttttttacttccttagcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92232 - DNA, 2885 bp, Homo sapiens
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagacactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92233 - DNA, 2757 bp, Homo sapiens
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatgtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92234 - DNA, 2408 bp, Homo sapiens
cggacgcgtgggtccggacgcgtgggagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92235 - DNA, 2786 bp, Homo sapiens
gaaaaacggatttaaagtataaactcaggaaaagaatgaaaacccatttattactgaatttggtgtaagacaagatgaccatctttttgtagggaaaataaaaacgagagcaacttaagatatacaggagcatcactaataataaaggaatacaaactatggaaatcaagaaatcagagaacttcttaatgatgagatatttgggtttaattttccaggagaatgtatttgaaaattttatgacttggctaaagtcgaatggacctttggagttgggtatagaaaaggatctttaacagtgtcccagtttctgtagttctagtttatacctgtatattgcacactcaggatataatctagttagttgaattcattattagtggcttaggttccttattctaatcaagctttttgctgtgttaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92236 - DNA, 2107 bp, Homo sapiens
gagatgatctagtaatgtactatagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92237 - DNA, 1468 bp, Homo sapiens
tctagaggttccccgtagtcgctaaaacgcgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92238 - DNA, 444 bp, Homo sapiens
gtataatttaaccaagatccttaatggatgtgttttatgtatgtactatataaaataggtcatcacgtatattatgtacttttaaaaacctattttcctcccagttagataaaaattccttgagtccaggaactatttgattgaatatgtatcatcataatcttgcttgatttttgacactcacttaaaacaatttgaatcgaacagaaaaaaagctctagtttcttttttaaaaattttaattctagtttctttttgaatctcacgtattgtctctcttctttcagctctggatgagggggatattgccttgttgaaaacttatgtaagtcctttcagtgtctacaaactatagatgttttatgttgaaataaaaactgttttggtattgtccttccaaaataattagaagaagttaagaaaccaaaaattaaaaaaccaaac

SEQ ID NO: 92239 - DNA, 985 bp, Homo sapiens
  misc_feature (12)..(13): n is a, c, g, or t
  misc_feature (853)..(853): n is a, c, g, or t
  misc_feature (883)..(883): n is a, c, g, or t
  misc_feature (902)..(903): n is a, c, g, or t
  misc_feature (907)..(907): n is a, c, g, or t
aaataggctagnnacgaggctggggtgcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgaggggctcgaatggttcgngactcttggaatggccgaaaaaaaagcggnctatttcttgagaatgggnnaggnggggcgtgaaaggggggggacaaggggacaaagtgggcggcacacacaggttggtcggagaaagggggaactctttgt

SEQ ID NO: 92240 - DNA, 1742 bp, Homo sapiens
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgtt

SEQ ID NO: 92241 - DNA, 1731 bp, Homo sapiens
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtaaaaagaaaaaataaaaacaaactacataaaaaaaaaccatgt

SEQ ID NO: 92242 - DNA, 1722 bp, Homo sapiens
  misc_feature (1587)..(1587): n is a, c, g, or t
gagatgcttatgagaacctttctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacttgattactgaccngaggttccgggaattaatggtcctacctatgctgtttaccttctacctttggcctgttcacagaaaaaaaaatgtccggccattaactgggccaataagctcagctgggtgcaacgggagtgtgttcaacgcgag

SEQ ID NO: 92243 - DNA, 2680 bp, Homo sapiens
  misc_feature (82)..(82): n is a, c, g, or t
  misc_feature (90)..(90): n is a, c, g, or t
  misc_feature (111)..(112): n is a, c, g, or t
ggacttaaaggcatgtgctcgagatgcgtgattaactcgggtagcagattgagtggagagaccgaaagaggatgagaaggangagaaggncatccgagctctggatgaggnngatatggcttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92244 - DNA, 3335 bp, Homo sapiens
atccttaattaaattaatcccccccccccccgcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtggggtaagatttctatttacaataaatacttttctttcactaaggatactgtctcacattcatatccttggctttgtagtgaataaatggactgagttccttggaataccaaaggatgatctagtaatgtactatagttgaaaattctgtcttctgcatctgcttcctaacttcccatcggcttcgctgactcccctactcccactgttgtttattatgaatggcttcaaatttcagagttgaggttaccagtccatttaaggtaacatggtataggttgggggagtacttgctttaggatagttgtgatgctaagtgtgttaatgtctatagaatacataacaactcacttagtaaattaaaaaaaaatctcccctccctcctcaaaggtttgattgctgttggataggttgtttgcgacattagacatgtagtttagtatcctcagatttcatgctctctttatttctctttatataattagggactctgtctctctcttgttttcttaaagtatggttttggggataaaggactaaacataaaagcactttgaaagcttaaagaatgtattaatgactatcttttttacttccttagcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92245 - DNA, 2513 bp, Homo sapiens
  misc_feature (12)..(13): n is a, c, g, or t
aaataggctagnnacgaggctggggtgcaaggaaggtgctgtgtaatcattaaggagcggaggcttttggagctgctaaaatgccggattacctcggtgccgatcagcggaagaccaaagaggatgagaaggacgacaagcccatccgaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92246 - DNA, 2434 bp, Homo sapiens
ccaggcgtgagccactgagcccggcagtattttatatatatattttttgagacagagtctcagcctgtctttattttactagtttgtttttcattcattagtgtcataacaagttaatacagcaagtagttccagggcactgggcaatgtattcaatttttattaaaattctcacttgtgagtttttcttttaaggtattaggtctattctattgaatttggacagtatccaaaaagcctgtgactgtatgttgtacatttctgtccctctcttaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92247 - DNA, 2028 bp, Homo sapiens
tgggcctcatcttcttgatattgagctgaaaatgacctcactgaaacttcccaccacaagacaggttctgccctctggctctgttatatttagctgttgtacttgagcgagttagagaatacgccggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaa

SEQ ID NO: 92248 - DNA, 552 bp, Homo sapiens
caacatttgaagcctcctggtatgtgaaatataaaacacacttgaaatagctattgagctggagaggaaaactccagaatggctgcggtggaaatcatcgtggcatcaggaatcatcctgtgacatacacacaggcaaaaatgataaaaattcttagtagaaacaaagtttgttcaaagaaataattatgtgacttcttcaaatggtgagtccacttacatagaacaggaaagcttcctcctgaaactccttctccagcactggtctgtctatcccagcatgaggaagtccttgtaaacattgcctgcaaatcatgtcgctgccactagagaaccggagagcattcctaagctccatttctagctcagaactaatattttactctcagtgtatttcattctattttattcattttaaaacttaaataacatcattcaaatataaaagtatttcttaagctacctctctgggtcaagtcctatgcagcatgatgagaaaacagagataaaaggtacaaaaatgtgttgtacagaaatatatcctgtgctccag

SEQ ID NO: 92249 - DNA, 375 bp, Homo sapiens
agaggaagacacaatgagatgtcatcagccccagcacaatggctaagttaaagaaccggcactgcccagtattggtgaagatgagggatatccagggcccttgtcctctgctgcaggatgtgtgacttggggcaaccaaccatttaggacaactgctcagcagtgtctcctaaagctgaacacacgctcatcctgcgagctaaaccctcagctccttggcacgcacctaagaaaaacaagcgcattcgccaatagataggcaaggaggctcctggggcctgacggatcccagccccacactgaaagcagtcccaaagtccacggctgggagaaaggatctgtgagccggcagcaggcacacaccacagtgacaaa

SEQ ID NO: 92250 - DNA, 493 bp, Homo sapiens
gtaaaaacaggttcatgttaagtaagaacctttgctaggctttgtttcttgaaatcaatactcaattgcctaacaagagggtatttatgggtaatgtgtaggagacggtctgtattgggcgcaggggcagaagtcaggagctttgtactgtttttatatgatctcaactgtttttgtgacttattacctgggaatggctgtctagaagagtcagttgttgcaccactagtgtctgttttatttctacatgggtgttatgggcgatgcaaacctgattttcttcgaatcggcctggcttcaaacagaaagaaaagaccaatttcaattttcccaccacatttagaagactgtattttaaaagaggaaaactgacggcaaattaattcttaatatgagtgcagaagaaaagagccttaggtgactttacctttagaacttgtgtaaaaatagatgggcaatgagaacgccttcaagtccagaaactgggtcagac

SEQ ID NO: 92251 - DNA, 327 bp, Homo sapiens
ttgcgtctccttccatctgtcttcccgctgtttccctgctcattaacacctctactagaaagtgggcagggtgatgacaagaaataaaaatacaagttgaactgcaactaagaatttaacatttaaaaaatgccaacgtaagaatgatataaatatctcaattgtgaaaatagactgcgaccctggttagtatatggtattttaaatatgtgaaaaatgtgaggaattggagcacatcccataaaaaagaacaagttcacagaatgttatcaagggaaaggactgcagagatagactgcaggagcatctttccatacaggtgggaaa

SEQ ID NO: 92252 - DNA, 239 bp, Homo sapiens
gctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttat

SEQ ID NO: 92253 - DNA, 225 bp, Homo sapiens
ttatctgagacaccgtttacttcaaccaagtcacaaataacctgattttgttattaaataacctctcaaaaaaaaaattcaagttctactgtgtttagctagcaagagttctgttttgcatttaacatatctaaaaggcctcatgcacaatataagtaaataactcttctcactacacaagtagatgctaaagcaacctagagattgaataacttctgtgagatc

SEQ ID NO: 92254 - DNA, 385 bp, Homo sapiens
tttatttatttctatttttaggggagagtgtagagaatgcttgagggcactaaaggtgaaaacaatatacaagaaattttatgacattttctctcaatagatatttctagttttagagccacattatacagtgcagagaaaaaaaaaatcttttttatttaatgttgatgtagccacttggccagcagagggagaaaatacaatacaaaatacatgcagtgatatttagctctctccattataaatgatgtgatattttatgttttcttttccatcactttcaggtcagaatatgtatgaaattatccaagaatatgtagttatctaaatcatctctaccatcttcccccaaatgttaaagtctgcctttatttttctttaggtt

SEQ ID NO: 92255 - DNA, 497 bp, Homo sapiens
gactgttgtggggtggggggagggaggagggatagcattaggagatatacctaatgctaaatgacgagttaatgggtgcagcacaccaacatggcacgtgtatacatatgtaacaaacctgcacgttgtgtacatgtaccctaaaacttaaagtataataataaaaaaacaaaaaacaaaatacaaaaaaagatatctattctggctttttcttttaaacagttccttattttttattttatgtttcaaaatttctcatcctgaaagcagtggtgattttagcctaatcactgaactgggtataaacaaaaataaaaaatatattctttacacaagcatgcagattaaaagcttttagagaaaaatcaagggacaaaaaattaaatcattttattttttcttatgaaaaaataataatggatacttcctatgaaaatatataaatacagaatgttatgttaaaacacaactgttacaaatactattttactgtagat

SEQ ID NO: 92256 - DNA, 428 bp, Homo sapiens
cctcactctgcgacctctgctgctgctgtgagagctccttctctgcctctgagtctcctgcttctctttttgttgagacacagtcttgctctgtagctcaggctggagtacagtggtaccatcttggctcactgcaacccccacctcccgggttcaagagattctcctgcctcagcctcccaagtagctgggactccagacgcatgccaccacgcctggctaatttttgtatttttagtagagatggggttttaccacgttggctaggctgaactcgaactcctgacctcaggtgattcacctggctcggccccccaaagtgctggaattacaggcatgagccactgcgcctggccaagatcttcaatttcatcacacccacaagcccctttggcatagaggttagcctgttcacatatctgggatta

SEQ ID NO: 92257 - DNA, 109 bp, Homo sapiens
catgggcctgggtaactgctccataagcaaacaatgtgcagtgaactggctcccttctgtgcctctcaccgtgcaaagacacttctgccccccgaatgcatatggccct

SEQ ID NO: 92258 - DNA, 735 bp, Homo sapiens
aatatgactgtgtcaaccacaaaagaggaaaagaatgggctttaaatcccgcctttacagccatccaaggcaggtaatactggagaattagggagatatgatgttttaaagtacagattctgtctccttttacaatactaaaccctagatcactgttctctgattgactttaccggttttgttgttgttgttgttgttgttgtggaactgcatcagaattttctatctaggttaaaatgccattctaccttacaatagcaccaaaggactaactaaaccctctatgaagtgattctccaaaggaaactgatagcctgcccactctatccagtctgtagatatttatttttgccttcagtatatttttaaaatttaaactagtcaccaattcttaaaaatagagacatttaacatcacattttaaaaatctaatttccagcttctcttcaaaaatcgttaagccttggccacattccaacatggcaacatttcacaggagccgtgtagtgatgtctttttctagacaaactctgtgatctccattttccacagtttccacccagctaatttcattcatttatgttgtgttttagtctctttagcatttgcatttgaggtcttggctctaaagattaagcgtgaaaattcttgataaaggtagaaaaattaagccatatcacaagaacatcctccctcaaatacctcacaaaataaagaaaaggagttttgaaagaa

SEQ ID NO: 92259 - DNA, 557 bp, Homo sapiens
aggtttcaaacctaaacagcgctcttcatcctggacgtgcgatgggggaggagtcggcctgctcagtccccacgacatagcaggactaggttgacaaacaaccgagatgggacacatcttgagaccctcacagtccttggaggaaggcagacgagaaaaagacaagaaaagtgttgattggctgcccttcttattaaacatcgacgcgttcactgacgaggacgtaaacaccgatctggcgtaccacgagcgtgtgtattttcgtttcacaaatactgcttcattttgagcatcaattctgaggtgggacgttatcaccactttttccactgagaggtgacaggttcagaggttgtttgtccacgtttgcacagcgtgtgaaggggaactgaaattgggatctactttccatacctttattctaagcaattatcaaatgcaaaaaagggaggagaggaggagaaacagaaaaaaatgaagataaacctcatcccctcctcaaggttatatataattctcctttgaagataaaatagcatttgttacagaaaaaaagt

SEQ ID NO: 92260 - DNA, 213 bp, Homo sapiens
ctgtaaagaaactcaaagttcagagctacactggtgacaaaggcaaaaagagtagcccgaggctgacattgccacaaaccccagtccctttgcaacagtggaagaaaaggcacttcagagatcaatgtacaatccagggcagcaaccagcgcctgttttaactgttaagattaatgctttgagcactggaactgctcctctaaatacccaatt

SEQ ID NO: 92261 - DNA, 342 bp, Homo sapiens
gcagactggcaatgcctttggtccccattccctcagtgcagccccatttagtgcagctgaggtgggaagcagaacagggttgccttgtcgctcaacctgtcacaggctgtggagcgcctgttgtctctggctccttcctttcacccagtttctaccctccgagaagatgcggcactgggagggaaaggaggggaagataggcacatctgcaggggtccagggctccggagatgggcttcccagagactgtgcctgagttttgaggagattaccacagggctcttggagaaatggggagactctccctctagggacagctttcagtaactcacaaagccgagc

SEQ ID NO: 92262 - DNA, 511 bp, Homo sapiens
tatgaatgacttaatagtcacagagacaccattaccttcatccccattttacagatgaggaaactgagggacagagtctaaatgacttgccaggggtcgccctgctggcaggagatgcagctaggattcgaacccaggcgatccctgctcttccccactggtgactctgcctgtccaggcaagcagctgccattggggcctgtcggtcggaacacatgggagccagctcttcctggcacgcacccccagcactagcttcaggaagggaatcattttctgttaccagctgctctcagataccattctcacctctgttttaaagctgaagactagctgggcatggtggttcacgctggtaatcccagcattttgggaggccaaggtgggtggatcatttgaggccaggagttcaagaccagcctggccaacatggtgaaaccccgtctctactaaaaatacaaaaattagttgggcgtggtggtgtgtgcctgtaatcccagctactcaggag

SEQ ID NO: 92263 - DNA, 365 bp, Homo sapiens
tgcctcttccagaacaattaaatacactattagccatgctagcccttacttattcatgactccctacctctagacagaaaactctgaggaacaactagtccctatatctcgctgcttactagatgtgcatgttctatagacactaaattcaatttgtctaaccatattcatccattaatttaacaagccattattagccaatgtataagacattggaggttcaatggtgaaagtcataccaattgaatttttggtacaattacttcaataatgtcaaacattacaaaattacaaactgaagcatactctgatggaaggaatgaatgtccttctcagagggtatgtaagcagcaagctttcccaca

SEQ ID NO: 92264 - DNA, 326 bp, Homo sapiens
  misc_feature (288)..(288): n is a, c, g, or t
tgcctcttccagaacaattaaatacactattagccatgctagcccttacttattcatgactccctacctctagacagaaaactctgaggaacaactagtccctatatctcgctgcttactagatgtgcatgttctatagacactaaattcaatttgtctaaccatattcatccattaatttaacaagccattattagccaatgtataagacattggaggttcaatggtgaaagtcataccaattgaatttttgcggcacgagctcgtccaaaaacattctttggatgntattcaaagccttattagcactgcacctgaataatagg

SEQ ID NO: 92265 - DNA, 315 bp, Homo sapiens
  misc_feature (290)..(290): n is a, c, g, or t
  misc_feature (294)..(294): n is a, c, g, or t
  misc_feature (309)..(309): n is a, c, g, or t
  misc_feature (312)..(312): n is a, c, g, or t
cttcagcctcctgagtagctggggctataggtgtgtactaccacacctgactaattttttataatttcttttgtagagaaggggtctcatcatcttgttgaggctgatctcaaacttctgagctcaagcaatcctcccgtctaggcctcccaaatggttcaacatctaaaaagaaacaatgtaaacagataattacaaaacaatgtaaataaacaagtcaaccaaaagatgacagaatgaatagagaggggtaaatacctgcggacgcgtggtcgaaaaagggcccggtncccnttcgccgtgttgtgngtngta

SEQ ID NO: 92266 - DNA, 620 bp, Homo sapiens
  misc_feature (3)..(3): n is a, c, g, or t
  misc_feature (7)..(7): n is a, c, g, or t
  misc_feature (14)..(14): n is a, c, g, or t
  misc_feature (34)..(34): n is a, c, g, or t
  misc_feature (44)..(44): n is a, c, g, or t
  misc_feature (396)..(396): n is a, c, g, or t
  misc_feature (490)..(490): n is a, c, g, or t
  misc_feature (574)..(574): n is a, c, g, or t
ttngacncctcttntttgaaacccgtttgcaaanccagctcggntcccggtggtgaataacgatggcctttacacacaagttaggaaagacgaagggattattgcattgccttcttttcctttgctccttatttcaagtaatcagcacaacccatctttaggtttcaacctttgcattttattcttggtagtagtttaatctttctacagatcttctcaggagaacacagtcccaaacaaattgggcttcgagtatatccaaatcagagtctgagaaaatttctcccaaaatattgtatgtaggtgatctatcttcctccctccttcactccctgtgtacctccctccctccctccgccatcgttattcaccacccggttgggtgaataaccgatnggcctcctagcggcaacaagggcaaatcaagcccaattaagggtctccaccccttgacttcccctcagccataagtaagggccccaccccaagncttaagccctactccactcaagcactatagttggtaagcaagggaaatctttcttactcatcccgctttcacccccctaagcanaaaaataggcccactaattccaaactctaacactatggcttaaggg

SEQ ID NO: 92267 - DNA, 977 bp, Homo sapiens
  misc_feature (753)..(753): n is a, c, g, or t
  misc_feature (847)..(847): n is a, c, g, or t
  misc_feature (931)..(931): n is a, c, g, or t
ttgtttaaatagtgagcattgtcatacaatctaaataaccatttgatttttaataatagctaacatttgttaattgcttatcatgtgctaggcattgtgctaaatactttaaagcctacatttgcttgcattagggtttagtttatatacagcaatgtttcagcaacacagtcatctttgtattctctgtgcatgctagctcagagccttacaaatgcaataaactcaaaatgtttgcatgagtgaaagaatgaatgaatgaatgaatgaatgaaatgctcagaaacagatgtcctggcatggcatctcaacacatcagggcgttgctgtctccttatctttgtgtcagtcttctctcaggcctactaaacaattctggctcatacagggattaggggagaaattattctgacttgcttttgccatttacacacaagttaggaaagacgaagggattattgcattgccttcttttcctttgctccttatttcaagtaatcagcacaacccatctttaggtttcaacctttgcattttattcttggtagtagtttaatctttctacagatcttctcaggagaacacagtcccaaacaaattgggcttcgagtatatccaaatcagagtctgagaaaatttctcccaaaatattgtatgtaggtgatctatcttcctccctccttcactccctgtgtacctccctccctccctccgccatcgttattcaccacccggttgggtgaataaccgatnggcctcctagcggcaacaagggcaaatcaagcccaattaagggtctccaccccttgacttcccctcagccataagtaagggccccaccccaagncttaagccctactccactcaagcactatagttggtaagcaagggaaatctttcttactcatcccgctttcacccccctaagcanaaaaataggcccactaattccaaactctaacactatggcttaaggg

SEQ ID NO: 92268 - DNA, 1032 bp, Homo sapiens
  misc_feature (808)..(808): n is a, c, g, or t
  misc_feature (902)..(902): n is a, c, g, or t
  misc_feature (986)..(986): n is a, c, g, or t
ttgtttaaatagtgagcattgtcatacaatctaaataaccatttgatttttaataatagctaacatttgttaattgcttatcatgtgctaggcattgtgctaaatactttaaagcctacatttgcttgcattagggtttagtttatatacagcaatgtttcagcaacacagtcatctttgtattctctgtgcatgctagctcagagccttacaaatgcaataaactcaaaatgtttgcatgagtgaaagaatgaatgaatgaatgaatgaatgaaatgctcagaaacagatgtcctggcatggcatctcaacacatcagggcgttgctgtctccttatctttgtgtcagtcttctctcaggcctactaaacaattctggctcatacagggattaggggagaaattattctgacttgcttttgccatgattacttgaaataaggagcaaaggaaaagaaggcaatgcaataatcccttcgttttacacacaagttaggaaagacgaagggattattgcattgccttcttttcctttgctccttatttcaagtaatcagcacaacccatctttaggtttcaacctttgcattttattcttggtagtagtttaatctttctacagatcttctcaggagaacacagtcccaaacaaattgggcttcgagtatatccaaatcagagtctgagaaaatttctcccaaaatattgtatgtaggtgatctatcttcctccctccttcactccctgtgtacctccctccctccctccgccatcgttattcaccacccggttgggtgaataaccgatnggcctcctagcggcaacaagggcaaatcaagcccaattaagggtctccaccccttgacttcccctcagccataagtaagggccccaccccaagncttaagccctactccactcaagcactatagttggtaagcaagggaaatctttcttactcatcccgctttcacccccctaagcanaaaaataggcccactaattccaaactctaacactatggcttaaggg

SEQ ID NO: 92269 - DNA, 377 bp, Homo sapiens
gcacaacccatctttaggtttcaacctttgcattttattcttggtagtagtttaatctttctacagatcttctcaggagaacacagtcccaaacaaattgggcttcgagtatatccaaatcagagtctgagaaaatttctcccaaaatattgtatgtaggtgatctatcttcctccctccttcactccctgtgtacctccctccctccctccgccaccctcctcttcccagttttagagtagaaataagaaatcttcaaactcttaaagtgagggtctgatttcttatttttagacaatagaattaggataattagttggatactgactaaagtcaggaagaatatagttgagctccataacccagaaccccctgga

SEQ ID NO: 92270 - DNA, 374 bp, Homo sapiens
gtatttttagtaaagacagggttttaccacactggccaggctggtctcaactcctgtcctcaagtgatccacccaccttggcctcccggaatggtgggattgcgggtgtgaaccactgcgcccggcctgacttatttgttcaaacagcctatgtaggtagaaaatttctaggtatgtaattccaaggtaataggtaaattgtgcctgattaagcatgaattttatttccctatacattagtaatttctgagagttgtatttaaattcgatttcagggtccttaggtaggaccttaggacactacacacagttcagtcttcattgcttgttatttaaatttttccacactttccagggcaactggttccccctta

SEQ ID NO: 92271 - DNA, 471 bp, Homo sapiens
attggaaaaataacgaaaaaaaaattaaaagaaaaaccgaccaacttcatgatcccacattttcattttaaagatctagcagttgatacatgtaaagagatgggattgaatgctgaccactacattttaatcagtttatgatcctaataagaatttaccagaatgtttattatcttaggtattaaaatggcaaaggagaaaaacattcgttttctaatacttatatagtaatacaagtattacttggggaatgtgtttgggctttggaggaattttactattattgtacaatttttgtttgaattatatacgatggtttgaaaagaggtaatttagctattctgataaaatttaggttagggaatttgtggaggaaggaatacaaccagggaattagtttctataaggacatgggaaatgctagtgacttcacctgccaagggagtgctttaaagttgggatttataaaat

SEQ ID NO: 92272 - DNA, 527 bp, Homo sapiens
gcatcctcatcttattctcttgttttcagtttatttacctacacttgatttttccttgttctgagtgtgctcagtatctcattttatcctttaagtaagatatatttaagtaagctgcttttaaatcctttctaaaaaataagatagagcataaatataaaagtatttctgtatctagccgttaacagcataatccttctgtcctccattgacaggtagaataactttgatgcttgtctcctccctaccctactttttgatacagtatgattttatgacctatttttctaggatcaacaaaacttggggagaattaacaccacctgaccagccatttggtgaccatcttgagctccgagtgctgtgttaatgacatgcataggcgggtcacaaactgtaacaaatccaccagctgaacacatgctgtaataagaataccagacaacttctccaaattttcccagacaaaatcaaccttgggaaccttgataccagacatcagcatgctctctagtttcaaaaccaga

SEQ ID NO: 92273 - DNA, 442 bp, Homo sapiens
ggggcatttaaagcatgacagtgttaaagtatgccccggctggcaaagcggacttcctgtggctaactgaggtgctcattaaacagatcaggtggccgtggctgggtgagggagcagtcatgtactctgtgttttgcagagatgctgttaaagtgtcacaggacctccctttctacgatcatgccaaaccagtttctgttgtcaatgcagagataggctgtagctggaagtcccccagctgaccaccaacagaccacctgacaccaaccaactgaccactgaaccagccaattaagaaagactggtgatttagggcttaaaggtcatccagtcaatactattcctcactcccctgactctcctcctctgtcctacagtttttgcttggttttagtttggaggggaacttaagtacacagatccttatctctccccatcccct

SEQ ID NO: 92274 - DNA, 761 bp, Homo sapiens
ctggtctataaatgcagatatgtgtgtgcgcttctatgtatggatgcttacatgtacatgcataggtagagaggagagtgcctaggccagatcactcagagaaagtgttaaattacaccattttgttgtttcagttacagaaatcttaaactaagcacagcttctctgacaccagtatcaatttcattactgagccatgagataacagcggtttacaagagaagatggtgaaaagattgagaattcaaatgatgaatgggatgcacacagaaaagacatcactgtgcgcgtcttcatgaggaaactgaattgagactactgtgccacaaatcaagtaatgtgtaatttttctttgaaagcatgtagaggctttaaagataacaactagcttttgagaaaacctaggattaaaaaaataatagaataagattagaatcttcatcatgtattcagtactttacatgctatattaatagtgaactaatacagattgaattgcatataatgcatttcaaacaatttgggattgaagcagaatattaatatgactacagaaattcagtccatttttttactaatgcaaaatatttgaaaaaatatttacattatatatcagccattatccattcattacattaatgatttttagtaataccttctttttagttatgtatttaatttaacttataaatttaacacaatattagagacatgcaaaaacatattagaaaaaacacaatatacattggcaaatacagaac

SEQ ID NO: 92275 - DNA, 424 bp, Homo sapiens
gggctgggctgggctggacaggcgctgggtggctggcgagaatctggacttggtcctggagtagcatgaagccactagggttctgtcttcttcttataaacaccaacaagttcattcagcacaaaaaggatctaatgtgtctcctctagcgcgtcttcctaacactggggctgggtgcagcttaaatgccaggaatgacatcagcttactaggagccagctgggaagatgactcccatctgaatcattcttccagtttaagcagggtcagcggcaatgaagagccacactgcctggagttaaatctcacctgctggcaggatgacctcgatcctctctaagcctgtgtttgcccatctgcaaaatgggaataaccacataacaccgacttcccagcttggtgtgaggagtaaacaaggtaataa

SEQ ID NO: 92276 - DNA, 514 bp, Homo sapiens
cccacggatgcagagagtctatgtatgtgcaatgtacttggaacagtgcctggcatctaataatatgactatataagtctttgtttttattgtgattaggaatattattattatgactccttgaggaagtcatatagtcctcagagaatttacttaggggaattacagagaaggaaagcatgctttcagataatcaacagctgttcttcatttcaccgtacacggtgacctgtagtccttttctacctgacagaggtgatattttccaacaccatccatctaattgtgatgcacagctggggactgagttccattatgctccagaaccccttcctaaaacatccattgctctgcaaccaagataaagggtaactcatgaactcattccttgtctccaaaagttgatttattactgtcaaggtcaatacaatactaaaatacctggccttgaaccaccattgggagtatttgagcaaccatgtagctgagaccacaccagcacaggggagccaac

SEQ ID NO: 92277 - DNA, 206 bp, Homo sapiens
tttaattaaatatctctgatggttagaaaatcagtgtcaaatatgaacaccgatatatagcttaaaatacaaacctccataattattaaagagcatggttaataactgttccaagtaagtgcttgataagaaacattttgcaggaggcgagtcacaggtctccttggaccggggttacggctgatggcgcagcctgccgtgtgcat

SEQ ID NO: 92278 - DNA, 678 bp, Homo sapiens
tatgtactaggcaccttgctagccatttcaggctttcttcagcatctgtggttgttctctggccaactatccttttctttttagtcatttaatatttgtgcccttgagggctctctcattattcttttgtctgtttatcccctcttgatattgtccctgagtggtaacacctgctctgttgactacatttacattcatataccaatgatatccatagctttaataagttgactgctccgtggttccctgtggatgtcatgtaagtaccaaaaataacaagtcttcgaagtgttgcctacctcctcatggtgtcatcattcaccagtttcagagtgtgggtgatagctctgagagagagagagagaaagagagacagacacacacacacacagacacagatagagacagagagagaaaccagaggacttttctgcttttgtttttcttttaggaggtaataaaaccgtgaatttatttaaatgctaatgtgtaggatttacttgagacaggaaaattggatgggagagtaaaggagtgtgatgatttgagtttcttgagatgacaggagttagtgagatttagaacatagattgggcttttttatataataaggaataatttctttgtataggaaagaataggggttaattatagaaataggtgtgtctctttaatatt

SEQ ID NO: 92279 - DNA, 338 bp, Homo sapiens
gacattttcatttataaaataaatttagggagaattatcttcttgatgttgagtcttaatcagtactgtgctatgtctttccattctcttaggtctacttttgttgactttaagtagtagtttatcatttttgttatgcaaattttggacatttattattaagtttatgcttagatatgtcatagtaaaatttattttgctatcataaatggaattttcccttctactttttatatgaagcctattggtttgacaacctgctacttcaataagttctctcattgcttgttagttgttgtcccatattatttagggcttttcagacacattgtatcctc

SEQ ID NO: 92280 - DNA, 311 bp, Homo sapiens
cttatttaaccaaattcctagtgttagacatctagatccttcccatgtctccaaaaagcatggtgttccctaaagcaacatcaccagaccacccaagtaaaccacttgctgtctcctacctggattcctggacctccttcatgggtgatcccccttgcttcctgccaccagcccaactccaatggggacttcttttggtcactccgagcctcacttgtatcagaacttctggtgccatagctcatgttgggtcaacttccaactcacctcatgaacttccaccagctttgtatgaaaagtcagtcccaagg

SEQ ID NO: 92281 - DNA, 211 bp, Homo sapiens
atctttcgctctatgtgccatcacctggacactctaggtaataccccctgttgggcaggggtgagctcccaaggcctcaggcaacccagctcccatgactttgctgggctcagcccacataactgttctcacaggatagagttgtacactggtgcttacagctttcctgggccagtgttgcatgctgccagtggctgcagcagcagcccca

SEQ ID NO: 92282 - DNA, 490 bp, Homo sapiens
atccattgatcatttcccttcaagaactcattgcatttcttgtttttaccattcatttgacatatctaatagttatatttttcttcctctactgaatccacatctttcctttttaatcagattaaaaaggctctcttgaggaccatttcttacatgtctttaaatttctcacaactagtctttaagcctttggagagaaggaactatggcttatttatggtgcctgtctcttcccctaaactcacagagtttggcagtatgcacttaataaatatgttttgaacaaatgagtagtagatactctatacatatctattgattgatttaagatttgctatagactgaatgtttatgtcccccctaccccatattcatatgttgaaagccagtccccaatgtgatggtatttggagatggaggctttgggaagtaattaagtcatgatagcagagccctcatgaatggaattagtgcccttgtaaaagaggcc

SEQ ID NO: 92283 - DNA, 383 bp, Homo sapiens
aacttggatgcaccttaacatatttgacgtgatttgaggtggagctgccaaaagtggatgacctcgagcctacggaggccttaaactggtcctgtggtttcctaagtacatttggcttcacagtatgaaactgattaagcattaagcaggaaatcaaaatcactgcaaaactgatacatgtgggcctcttatttagttcaaatgttctctttcaaaatcctttcttaattttggcaaagactaacttagtatatgacaaaaattaactttaagaaaagaagctggcttatttccttttatctttcctcaaccttttaaatgttccttaggtttatcaacgttttccacaggtcatgaatgaccctgaggtattggggaggaag

SEQ ID NO: 92284 - DNA, 507 bp, Homo sapiens
ccacaagtgctgcaccctgtgctaacaccaccaccagcaggaccacatgcacagttgccagtggagggccccggctccctgagccattctgtctctgctgctgctgtgaatgcccacagggagacaggcaccctgacacctgctagcacccttccacagctgacaagtctgcacccctccacactgccactccaccaccactgccgctgctggcacatgcaagcaaggatggatctgctgccaccatcctacaaaatggtatggctggcaccatccatcagagtgtagtgaccagctgtccaggagcacattggcccccccagcgcaatgagttgacgaccttgaggagccagagagcaaaattggggcccagtacaagtctcccagagttagagcacacagcccaggagctgggagctgagcactggctgcctaaaattttccagaaacaaaaccagtctactgaatccaccttataacacaatcaaaccctcaaagttatcaagt

SEQ ID NO: 92285 - DNA, 235 bp, Homo sapiens
atcattaatacttaacgtattagaacttaaaattgagaaacttaaaaaatagttttttatttgaagatgagcaatattgagtgcattacatttagcatagaaaacatcttagtattaatatgaaaatcattttgactggccaggcgcggtggctcacacttgtaatctcagcactttgggaggccaaggtgggtggatcatgaggtcagaagattgagacatacagtgaaacccc

SEQ ID NO: 92286 - DNA, 510 bp, Homo sapiens
cagacaagagcgcagtcatacatttgataacagttcctactgtttcctgaaaattatatagcatattgtgatttaagatataaaaggggagactgcgccttaggacttgcctggacatgagatcttttgcatagacttggtacctaggcttatggtgaacctagaaatgtggaggtgccctgaacaaaaggtagcatggaatgaataagcaaagtctttgggaggtgaggatttttcttggccttctagttgccaggttcccaggtttaacccctgtgttcttattttcagagcctcagttgaatggggtagagatgctttcccagaggcccagactgcctactgtctttgagaggagaagttgtactgtggcagtccttatatcattaggatgtgtgtgtcatctgggtggtgttttaatttaacactccattgtacacgatagcaataagtaataaataaaatctgttctacttaagaatgtttgtgtctagaggccacgtgtttatt

SEQ ID NO: 92287 - DNA, 2171 bp, Homo sapiens
  misc_feature (5)..(5): n is a, c, g, or t
  misc_feature (19)..(19): n is a, c, g, or t
  misc_feature (22)..(22): n is a, c, g, or t
  misc_feature (31)..(31): n is a, c, g, or t
  misc_feature (77)..(77): n is a, c, g, or t
  misc_feature (93)..(93): n is a, c, g, or t
  misc_feature (107)..(107): n is a, c, g, or t
  misc_feature (191)..(191): n is a, c, g, or t
  misc_feature (208)..(208): n is a, c, g, or t
  misc_feature (440)..(440): n is a, c, g, or t
  misc_feature (481)..(481): n is a, c, g, or t
  misc_feature (602)..(602): n is a, c, g, or t
  misc_feature (705)..(705): n is a, c, g, or t
  misc_feature (783)..(783): n is a, c, g, or t
  misc_feature (1234)..(1234): n is a, c, g, or t
  misc_feature (1241)..(1241): n is a, c, g, or t
  misc_feature (1391)..(1391): n is a, c, g, or t
  misc_feature (1426)..(1426): n is a, c, g, or t
  misc_feature (1441)..(1441): n is a, c, g, or t
  misc_feature (1624)..(1624): n is a, c, g, or t
  misc_feature (1684)..(1684): n is a, c, g, or t
  misc_feature (1765)..(1765): n is a, c, g, or t
ggctncaaatgtccacttncanattctacanaaagagtgtttcaaagctgctcaatgaaaagtaaggttcaactctntgagatgaatgcacanatcacaaagaagtntgtcagaatgcttctgtctaggttttatgtgaagatatttccttttccatgataggccccaaagcactccacaggtccagttgnagattctacaaaaagantgtttcaaagctgctcaatcaaaagaaacgttcatctctgtgacatgaatgcacacatcacaatgaaatttatcagaatgcttctgtctagtttttttgtgaaaatatttccttttccaccataggcctcaaagtgctccaaatgtccacttgtagattctacaaacagagtgtttaaaaactgctaaatgaaaagaaagattcaactctgtgagatgaatacacacatcangaagaagtttgtcagaatgcttctgtctagtttttatatgntgatatgtccttttccacaataggccagaaagtgctccaaatgtccacttgcagattcaacaaaaagagtgtttcaaagctgctcaatgtaaagaaaggttcaacactgtgagctgaatgnccacatctcaaagaagtttgtaagaatgcttctgtctagtttttatgtgaacatatttccttttccaccataggcctcaaagggctccacatgtcctcttgcngattctacaaaaagagggtttcaaagctgctcaattaaaagaacagttcaactctgtgtgagatgaatgcaaacatcncaaagaagtttctcataatgcttctgtctagttttgttgggaagatatttccttttccaccatatgcctcaaagcgctccaaatgcacacttgcagattctacaaaaatggtgtttcaaaactgaccaatcaaaagtaaggttcaactctttgagatgaatgcagacatcacaaagtagtttttcagaatgcttctgtccagtttttatgtgaagatagtccttttctactataggcctcaaagcactcgaaatgtacacttgcagattctacaaaaagtgtgtttcaaagctgctcaatcaaaagaaaggttcaattctgtgagatgaatgcatgcatcatgaagaagtttgtcagaatgcttttgtctattttttttttttttttgtgagcaacaaggctgtttatttcacctgagtgcaggtgggctgagtccaaaaagagagcaaanggtgatnggattatcattagttcttataggttttggaataggcagtggagttaggagcaatgttttgcgggcaggagttggatctcacaaagtacattctcaagggtggggagaattacaaattacaaagaaccttctcaaaggtgagggagattanaaagaactttcttaagggtgggggagattacaaantacatcagttagtgngaagcagaaacaaaacacaatggtggaatgtcatcagttaaggctattttcacttcttttgtggatctgggacgtgaggagtgcctctgcctggacgcccattgtctgggatgtgaggagcgcctctgcccggccgccccatctgggaagtgaggagctcctctgcctggccaccccgtctgngaagtgaggagcgcctctgcccggccgccccatatgggaagtgaggagcgcctctgcctngccaccctgtctgggaggtctaccacagaggccagacgcagtgtgggggctggacgtggtggctcacgcctgtaatcccancactctgggaggccaaggtgggttgatcacttggggctaggggttcgagaccagcctggccaacatggcaaaacatatgaaaattacaacaaaccaaacaaccaatcaaccaacccagcaacaacaaaacaggtctaccctggagtcatactctaaatttttctattttcctccctttctgatcctttatcccactttctttttcttcctcttccttctccttcttgtcaaagacatagaggattgagttattatcattgatcaatacaaagtccctctctcatttattttctttcattcccaccccccatttctattccccatcttcctgtgtgcaaccttcctaatatgtttgatatgcttctttttgtatatatttttagaaaatgttaaataaaaaaaattt

SEQ ID NO: 92288 - DNA, 924 bp, Homo sapiens
taatatgtggaatctgtttccaagtatcaagtcttctgtacgctttcacacaatgtacataatagctgcaactcggcttttgtaatcagtggaatatatttcagatctgtccaggttgacacagtttggtcatctttgttttgttttatgactgcaccacatatttgatttgttttatgactgcaccacaattaattaaagtctcttcatgctgatacaaaatgaacataaatatgatgacataccaacatagatttgcttatgtggttgcctttattgatttgtactataaagaaattaaatagaagtatttcagatacccatagtatagctgtatacactgccatagctgtattgagtacattcattaccccttagagccatgtttttccatcatgttatgactctgaaaaactccagtgtatgcttttcagagaatgacattggaaagaagaaatggccaaagtatcatttggtaccttggcttccttacatagatgttgaactccaggaatgatcaaatcacagtttaggacccctttgttgggccctataaagggtttccagatgtcaaatgatagtctccagatgaagaaatgctctataatgcctcaccgctgtgttttcctgtattttgtgcttttctgaaaactttaaatacacgaatttttggtagaaatgaaaatctttctgttttatatatttgtttttgtccatggcactctgatctctttgaatctggtaaggatctagccttgtcttgtttataccagcaagcagtgttgtcacttaatgctctcatttttcacgtaaatgactgacattttcccaagtcttcacaagtgatttctgaagatgttgctgcattgagcagagactatgtcattgtaattgcagaagttttaaaattaaacatgtttaata

SEQ ID NO: 92289 - DNA, 831 bp, Homo sapiens
tggtattaccattataaataggatacatgtgcacatttttggtgaaacaagaaaagggaaacccccatggtttcattgtctttaaatatatattttctcatgttacgaggtccttgtttctatcaaaaagggttggatagaaagtaaaaatgatggctactgttagattatctttagaagagatatatattattaaaaataccattaacttttaattttgaaataattgtagattcacaggaaggtgccaagatagtacagagcggtcccatataccccctttttttgttttctctagtggttccatcttacaggattacagtacaatatcaaaaccaggagtttgatattggcacaatatatgtttgtaggtcgtggacattttatctcatatatggtgtaaccactgctgaagtccagatactggatgattcccatgtcacaaagatttccctcattctacccctttataattgcaaacatcctttcctctactatctccaaatggtggcatccactaatctgtcttacatctctctcatttcgtcattttgagaatattgggctgggccctgtggctcatgcctataatcccagcactttgggaggctgaggcgggtggatcacttgaggtcaagagtttgagaccagtctgaccaatatggtgaaaccttgtctctactaaaaatacgaaaattagcctgggtgtggcagttggcgtctgtaaccccagctacttgggaggctgaggcactggagggggaggttgcagtgagctgagatcatgccactgtactccagcctgggtgacagagtgagactcccatctcc

SEQ ID NO: 92290 - DNA, 171 bp, Homo sapiens
agaacatcaggggggaggaaacagagaggagggaacagcatggagagggaacagcataggggaggataaccaggtggatggatggatagatgtatgggtggatggatgagtgggtgggtggatagatggataatgaatgaggtaccgagctgacagggtggggtaggtgcg

SEQ ID NO: 92291 - DNA, 435 bp, Homo sapiens
tcctgcataggtctgagatgtgggcttcatgtatgtctggcaggcatccaggctttcccatcatgtgtctgtcccctgggtcacatccatgtcaggtgggtaccacagtctaaagtccttgtattctcttccacataccagggctgataatttatcagttgccattgatcaaagttcacaaggcaaatcttcataaacttctaaagctgcctacagtttcccgtaaacaaatctctaaatttacaaaagcaatgcttgctgattgtaaaaaacacacagtgccaaagcatacaaaggaagaagacccgcttgcaatttgctacctacatcccactcttggggccaacaactattggaagtgtggtgagtgattgacttacatccttctagatcttatctacatatttgcaaagaaaaaatatacatatataaaat

SEQ ID NO: 92292 - DNA, 723 bp, Homo sapiens
tcacatgtaaatctatgcaggtcttttttattcttttttgttatacagaaataaaagcgtactatatattctatacctttttaaagttaatgtgttttagatttgcatgtgatcacatgtttatctacctcattgctctagtagtagacattctaagttgtctgtagtgttgttgtgaagcagatagctttccaagacagcgtaagcaaacgacacaaggcttctattaccagggtttagttgatagtgatgtattggacacattttattttctaaacttacgtaaaactattttctgtttatttgcagtcataattttttgagctagagttcacatagaggtgatctaatctgtcttataccaggaagtctgaggcccagagaagtgaattcgcttgcccagaggcacacagtaagtgccagagataggactaaaacctgggacttctatttagaatttttggcgtacatattttccagctgcaaattttgctgtaattttgttagatccaaggaatagcagggatggaggaagcgttttgtgtgttggaggctttttaaaatcatgtaaggaatataattctgcttactcccaatatcagtctttgatgggcttatccatgttatgtcattttaacgtccgagaaatcgtccgtcaagtgggtaattcatgccgtcgtggtgactcttatctgaatggactgtcagcagtaacttgggttg

SEQ ID NO: 92293 - DNA, 526 bp, Homo sapiens
gtcagggggtggggggcaaggagagagagagcattaggacaaatagctaatgcatgggttgataggtgcagcaaaccaccatggcacatgtacacctatgtaacaaatctgcaccttctgcacgtgtatcccagaacttaaagtaaaacaaaataaataataaataaagggaaccatgtggatttacagcatgtaaagacaccagaaaacaagacaaaggaccatatggacaactgcttcaatgccctctggctcctactggaagttggcttgggaagctgttccctggacccaaggttaagttcaggagttacatatcctcttggagtagtgtttccaaattttgactaaattttcctgattatggaaatttttcaggttctggtaaaaattatatatttcatgtcccaccccagacctatcaaattggatgaggattatattaatatatttaatccaacaatgaggcatgattgataaatactaactcttagaggagctgaacaatttcacttgcaggggggcc

SEQ ID NO: 92294 - DNA, 236 bp, Homo sapiens
gcacgaagctgcatttccagcctgagtggccagctagagacgcacttaatcctgaggtctgtgggcagaggccacgtccttcaaagtcaagtggttattaaagaaccggcactgccagctccaccagcgaagtcctcctggttcccaaaatgaggagactgaggagctggggttggcagacccttgccccagagccagagacgtggggcccatctggggaacaacatgccagcctt

SEQ ID NO: 92295 - DNA, 408 bp, Homo sapiens
gacatgcatggagctactctggttatagtcctgccgggcaggtcagattaatcactgagtctgatgcacctggcaaccatcaaacagcaaaaccaaaaccaactctttccttatgtaagtcaatcagagtttctgttgactgcattcaaggaagcccagccaattcaggaggaaatgccgttttatttcaaaagcacaggcacagttcgtacatttgccgagggaggtaacggaaggtgtcagctgagactgatcaagtgcaccctggttcaacggactcttaactggtctttccccatcagtctcgcttgaccccaaagccttcaggaatacactggattccagaataaatcaatttattccagatacatctccagaaaacactttttggggaacaggtgactagca

SEQ ID NO: 92296 - DNA, 306 bp, Homo sapiens
taacaagctgtagagccttcaggccaggggtacagaaaagtgtaaaggaaggagctatgttaaaacaaaatgtatatgggccaattttcagtacttatctcagccttgcagccctactgcctgcctgtctcagggtcatacaaggatttagagtttagggggtgagtggtctcatggcatttaactctttggatattcctctcatcatttattgggtatcattcgagtttggtggagcccaatgtctggatttctaccaggtcatgcatctgcaggaagagctattcttccactgagttttcaaaa

SEQ ID NO: 92297 - DNA, 415 bp, Homo sapiens
tgcacgtgctgtgttctgagaggcgaggttagagcccagatcatctctattcatgtgacacagccattcccaaaaggacttagagcagagggaacttgacccccatcttaactgtctcttttgaggatgagcagagttctcaggtgtgcccccagcctggtttatataaatgtagctttaatctaggtgtgagcagatgtctgttggggatctctggacaccaggcctactctggagtcagagaggggacccgccatttggctctctggtacagtgtggacagtgtctgctcctctacttgtcatggctgaaagtactgcagtgccaggaaaccctctgggaagttctttcttctacaaccagagaatgtcatgacagctgcagtactttcagccatgacaagtagacgagcggg

SEQ ID NO: 92298 - DNA, 487 bp, Homo sapiens
ccatgtgcgtgtctgtttccaagaaaaggtgactgtggaaataggaaaagacttctgctgaaatgctgaatgttatactgttttcttgggcccatcttaataatcatctacaaagctgcaattttggcaatatgagctggcggcctgacctaacatcattgtactttggatcactgaagtgtctcctcacatgccaaaacctgctgcactttcttcctacttcgttgcggccttcatcaaccttgtccacctctttcagtcacctgagtctctacgtgcactgttcagtatggcagccatgagccaatgtggccaccaagtatgaagaagggagccttctgaattgaatgtaaaatgtacactggctttccaagacttagcatgaaaaaaaaatgtggaataactcaataatctttgatattgcttgcaggttgaaatgataatattttggatatagtgatttaaataaaatatattattaaaatta

SEQ ID NO: 92299 - DNA, 345 bp, Homo sapiens
gaaagaatgattcctccctgtcccacaccttactgccacatcaacatggctcataaataataacagggaatcacaactaaaataactgtaaggctcagattgtttaggagtcccttagggaaacctgaagacagcaaggatgtgaaaaacaaagatagagaaaattataacctctgacacctatggtttgtacacaaacattaaacatagtcttatgccttgccaggtctacataaaacttcacaccaaaggcatatttatttctttcttttacccagtatatcatatccagcatttagcaaaaaattacaagacgtgtcgaaaggcagtaaacacaatttgaag

SEQ ID NO: 92300 - DNA, 231 bp, Homo sapiens
tttattctgggaatacaaggctggttcaaaatttgaaaatcagtcaggataatttagtctattagtagactaaggaaaaccatatgatcatctctttagatggagaataagtatttgacaaactccagtatactttcatgataatttttacaggccaagcgtggtggctcatgcctgtaatcccatcactttgggaggctgaggcaggagtatctcttgagcctaggagat

SEQ ID NO: 92301 - DNA, 371 bp, Homo sapiens
gattgataaatgaatgaaagaataaatgaagggaggaaggaacaagcatactgcatgtcagaagggcatactcaaccacagatcaaatgtacagctttgagatggaaattgtattaatttgggatatctatctacttcaattcttagatatacttcaatctttttagctgctgtacagtatcccacagtatgaatgtgctgcaggtaatttagccatacccttaatggtgggcatttaggtcacttcacacatttttctgctgcaagcaaatgttgcagtgagcattctcgtacaaacatccttgcaggcacatacatgcaagcattttgctagggtgaatactgagaaattgccggtggataacctatgg

SEQ ID NO: 92302 - DNA, 470 bp, Homo sapiens
agcacgagaccctcagcagaaggtgagcagatgccagcactatgctccttggacttcccagcctccagaatcctgagctaaataaatctcttttcaagtaaatcacccagtttcaagtattctgttaaagcaacagcaaacagactaagacacttggagaggtctccctaataccctctctggagtaggtcttccgggctgttccagttctcatttccctctttggccttcttagctcttgtcaaatttgtaattactcatttgtgtgcttctttgtttattacggtccccaccagattgtaaacccacgagggcaggggctgtctctgtttggttcactgtgcatatctagcatctggcacattgtgggaatctattcatagctgttggatgaatgactgagggcagagtcagaacagaggatgaggataaagaggatgaaaataaagtggaggggacaggtggctgac

SEQ ID NO: 92303 - DNA, 592 bp, Homo sapiens
ttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatag

SEQ ID NO: 92304 - DNA, 1065 bp, Homo sapiens
ttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaacctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagcca

SEQ ID NO: 92305 - DNA, 433 bp, Homo sapiens
aaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttga

SEQ ID NO: 92306 - DNA, 320 bp, Homo sapiens
gcaggatacttactttctacatgtactttataaaaattatttttccattttattgtgagattagtttaagtgccagaaatttttttgtgtggaatattttactaactcctgacagaaaatgcagaacttcccaactgttaattaaatctttataacatcctgaggatatagaagggagctcatgatctccctagagcatctttgactccagcaggagtaaaatacccagtaggttttcctttttacaggcaatgactcaggctaaacgtatatgtgttcatgtatttacttagcctctgctttctttcatatttcttctc

SEQ ID NO: 92307 - DNA, 456 bp, Homo sapiens
ttgaactcccgacctcaagtgatctgcccacctcagcctcccaaagtgctgtaattataggcatgagccactgtacccagccttaagcaattatattctgaatcataaaagaatgtgtcagggtccagtcatgaaacagcctgggcgacagagcgagacttctccaaaaagaaaaaaaaagtcttgacccttgagaacgcatatttttaatattctgtgtgatgaatgggaagtgtacataaagcatttctgctgcatatcaaagaactatgattgtctcaaggaaatagccctgtgggaatttcttacttgtattttcctggaatggactagattttaacttgaaaaaaaatgactgacaaactgtggttattcagatttgggtgtttggcacatgttttcacaaaaatgaacagattgagctgtagggtgaccagctgttttagcacctcaagt

SEQ ID NO: 92308 - DNA, 511 bp, Homo sapiens
tctggcgtaccgggcttgcggcagatcctgctgtttctccacccacccgcctttccctctccttgtttccgaaggagagcctgcctctcgccccgaggttgaacattccagctccttgctctccccggcaggaagccccaattctgccctgcagtggttgcctggacaccctcgtaacccagctgagcctgcacccccggggcctgggccactctgctgctctgtcttgcacccttgacttcctttgagggttgactctggacccttaagcctcctccttccttgcctggagtttacccacctaggccggccgcctggcaaggactggctggtgcggggcctgaaagcctggccctcgcctcaaggtgggactgtctgggctgtcactgatgccccagagctcccgagggatcctttgcctggcttcttcccgtcgtccccgtcctgtttccccactctcttcccgcctgtcccagactgctaccttcctaataaatggcttgtacagaaa

SEQ ID NO: 92309 - DNA, 400 bp, Homo sapiens
gaatatcccttaatcattataaaataaattgcaattaagtctggggtaagttgttttaacctctctgagtctcagtttcctcatctgaaaaacagtattattattactattttgcaagtttgagcatatggatgagaactaacacaggcaaagtccctcacttagcatatcttgaaagagagtggtggctctacaaagggtggatgactgaaaaacaaggcataattttcagtttagattttagagtctgacatgccctttcacatacattacttaatttcatttttaaaaatatagtaccattattggggttcttcttcatatggcatccctggagtcatcaaagtaaaaatgaaagaaatcaatctagcttggaaaatcttaaggaacttaataattg

SEQ ID NO: 92310 - DNA, 392 bp, Homo sapiens
aatgagttaaaactttggaggctgttaggatggaatgaacttattttgtatgtaaggatatgaatagagtggctaggagtggaatgttatagaatgaatatttatgttgaagccctaaccccaaatgttatatttgggggtggggggcctttggaaaataactaggattggagtaggtcatgagaatggggctgtcactctcactaacgcccttaaaagacttggaagaggcaccagtgctcttgctctctgaaatttgaggacacaggaaaaagggggccatctgcaaaccaggaagagagccctcaccagcactcaaccattctggcatcttgatgttgaattatgaagactacagaactgtgagaaataaatgtctgttgtttaagcca

SEQ ID NO: 92311 - DNA, 246 bp, Homo sapiens
ggcctctcctgagaggcagtgaagggaggtaccagcagactctgagggaggcagaccactgcgtagatgacagtcccatggggcaattacagggacttcctggatacacagacaagtggccctcagagaggttttggttccagaagcctctccttgaaggagcccattcagaatttttcagtaactttgtctgatgacattcacttagctgtgggctctccttcaaccctgaatgaggacatggtg

SEQ ID NO: 92312 - DNA, 458 bp, Homo sapiens
tatacagctcgtgccgaattcggcacgagctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 92313 - DNA, 3514 bp, Homo sapiens
ggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 92314 - DNA, 3514 bp, Homo sapiens
ggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 92315 - DNA, 3568 bp, Homo sapiens
ggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 92316 - DNA, 3514 bp, Homo sapiens
ggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagcctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 92317 - DNA, 188 bp, Homo sapiens
aaaaaataaataagacagtctccctctgtctccaaggttggagtacagtagtgcagtcatagctcactgcagcctccaacgcctgggctcatgcagtcctcccgagtagctgcaccacaggcatgagccacagcccccagcttccagaacctttttgttttccaaaactgaaatgctgtactttaccc

SEQ ID NO: 92318 - DNA, 385 bp, Homo sapiens
ggtggtgttgccagaaggtgactgggctgtagaaacgaaataagacagtcctatggtaaagaaaagctagagcggaaaggaggggaaccaagtcctgtgaatagaggtagcaccctgagaaacccatgtcatcccaagggtgcccaaacccatagctggccccaggtctgtgcacttaaggctgggatgcttagactttcctgggtttctgtgtctgtatagcctcttaatgtttcttgagataatttgaatgattttactttcatctacaataacccaactgattgggcaggttcttatgggtagaattacatggtcaaaaataggaacatatttaagttgttgatatcttaaatttcctttgaaaaatataaatttatatccc

SEQ ID NO: 92319 - DNA, 160 bp, Homo sapiens
acaacaacaacaaaaattgtttctaagtgaaggagaaatactttctcagacaaaaaaaattaagggaatctattaccttgcaagaaatgttaaaagaagttctttagagagaagggaaacaaaatatagatcagaaaccaggatctacataaggaaggaa

SEQ ID NO: 92320 - DNA, 333 bp, Homo sapiens
ggcaacacatagaaactatgatagctgtttttattccagaggatgaagttttaaagaaatataacacagtttagttatagagactatttgaagagatagacaatgataaacgaatgctatgatatagaaacaataggatcaataatgagtatttaaggagctcagagagagttttctggaagaagcaaaatgtgatgtttccatagggtaatgagcctgtctctccccttcctcctatatgacttttttgtttcttatttgaccttcacagtggtatgggacaagaatcaaacatcctaattaaaagacagaaaaacagacccccgcaaaatc

SEQ ID NO: 92321 - DNA, 568 bp, Homo sapiens
tcaggcttttcctctctctattttatgaggttttacaattctcaaatcatccatgacaatttttaagcattgggtatggggtctggattaaataacttgcctttgctatctgattactttttttttttttttttttttgagatggagtcttgctcttgttgcccagtctagagtgcagtggcacaatctcagctcaccacaaccttcacctcctgggttcaagcaattctcctgccttagcctccggagtagctaggattacaggcatgtggcaccacgcccggctaattttgtagttttagtagagatggggtttctccatgttggtcaggctggtctcaaactcccgacgtcaggtgatccacccatctctgcctcccaaagtgctgggattgattacaggcgtgagccaccgcgcccagtctagtctgattacttttttcctaccttaaatatcatgatcttaggatcttagattttgttattgcccaagatttaggatgctttgcattgtgtattcagcttattagctttgtgttaattttgaaaaaaaaaaaagccaaaagaa

SEQ ID NO: 92322 - DNA, 181 bp, Homo sapiens
caaaaaaaaaggcaatgaataattggacaaggaaccaaaacttttattctgaaaagagaaaattccagtctatagcaagggcagttttccttctaaggaacagtactgatatatcatggctaaagaagcaggctcagcttctttgtccctttcactaatttgctatggcttctaacatagg

SEQ ID NO: 92323 - DNA, 433 bp, Homo sapiens
atgcagtgtagattaccactgtactagccaacattttcctgggcccaccattttggggttgtattcacatttttgttttatcttttaccaactttatgccttctgccctttgccttttgttgtaagtctagaattcatagggtggctttcacgctgtacctgattctgttctgctccgtatatactagtccccccttacctgcggccagttgcaatccaacatataaataacatattttggccaatcgcagtggctcacacctgtaatctcaacacttaggtaagctgaggcaggaggatacttgagcgcaggagttcaagaccagcctgggcaacatggcaagtgcctatagtcccaggtactcaggaggctgaaatgggaggatagcttgaacccaggaagttgagatgccatgagccgtgatggtgtcac

SEQ ID NO: 92324 - DNA, 218 bp, Homo sapiens
acaatggttgtgccaaaaagggccacagccacgtgcagcctgtttgctgcacgaaccgtgcctgatgcgtgcccaaggacaaggccattaagaaattcgtcatttgaaacacagtgaaggtcgcagcagtcagggacatttccgaagcgagtgtctttgatgtctatgtgcttcccaagctgttatgtgaagctatattactgtgtgagttgtgcaac

SEQ ID NO: 92325 - DNA, 359 bp, Homo sapiens
aggggaggagcagttaagtatctggtgagactacagacaagggggaggcaacaaggaagttggacacagaagcagccgaggttcacccctaagcccctgacactaacagatgccacatgtatgcggcggttcagatctgccatttagggcaacaggcctagatcaaagcgttgaggaaaaacaccagtaggcaggtaggacttggtgtctaaagtgagggcaacacacatcaggagatgctgtaggcaagagtagacactgaggaagttggacagaaaagcagctcaaacacatccctgcccttggccttgcacgggcctactcgccaaggggttcagacaggtgcccagaggcttttc

SEQ ID NO: 92326 - DNA, 151 bp, Homo sapiens
aaaataaacaataagagaggaaaaaaggaaatagaaaacaagaagaaaacaatcaataaaatgacaggagaaggcctcacttatcaataatcaccttgaatgtaaacggattaaattccccatttaatcaaaaaggagacttttcaacaga

SEQ ID NO: 92327 - DNA, 440 bp, Homo sapiens
ctggggtgtgagcgggctctgatgaaatgcaccatgttcactggaggacaggatctgccttggggctccttaagtcctagcacatggaagaggaaggcatggattggaaggaaggccaccaaggctcctgcctgctgaccacatccagtggctccagagcgccaatgtggagtgccagccctccgtggagaaggggagggtgaaggaaagccttggcatcgcctctccaggccgtgagagcagggctcgggaggtgccgtcgtaaagcactggagtgactccccagaggaagagggattttgggggcccacttgtggctctgcctaatttctgttggagagacggagctggggcatcattcatggaggacagccagagccacgggcactcagggcggggctgagcactcgctccaggtgggaggcaacattggcatgggg

SEQ ID NO: 92328 - DNA, 168 bp, Homo sapiens
attacagagatgggggagttgactgattgatagcttcagttgaactgggattgagagaggtgtggttgtgagttattattgaggtcttggcctcttgtcactgttcataatccaggcctgtttttgtaaacaataggccactggcctccatgtcctgtccagatgcat

SEQ ID NO: 92329 - DNA, 676 bp, Homo sapiens
cactctgtcatctggagtgcagtggtgcaatcttggctagctgcaacctccacctcccgggttcaagcgattctcgtgcctcaggctcccaagtagctgggactacaggtgtgtgccaccacgcgcagctaatttttgtatttttagtagagacggggttttgccacgttggccaggctggtctggaactcccggcctcaagtgatctgcccgccttggcctcccaaagtactaggataacaggcatgagccacagtgcctggccatcagcagggtatttttaatagggaaaagactaccttctaagtaaattctaacacatatacaactctctccagtccatctctgttatacaagagcaaaaataaagaaataattctagcaacctggtttcaaacattgtattaactgctcctgccagaaaacaatatggcagcctgtatcccaaatatgaaacatccttatacttattaaaacacattaattttcatctggaaatctattctaagaaaacaaatacagaaaaagtttcatgcacaaatatgtccatagcagcataatctgtgataatgattcacatgaaacagcctaaatgtccaatgacatggttgtcactaaattatttaatactgtaataataaaaaaatgatgatgataatggcagctgacatatatt

SEQ ID NO: 92330 - DNA, 1282 bp, Homo sapiens
aggggtcccaggccaccgagccaagccaccctggtcaccttctggctcccgcctctgtgctgcacctgagtgtgatgccctgggacccccattaagtcaggctgagtcttgcacccacaccctgcgactccattttctgctacaaaggatctctctgatgttgacgagcagcatggagacttgggggacccccccaagcgcctcctccatgtcatccttgggctccagcttggcgctcacacacacaggaaaggacttcagcttctcctgggagggctggctggctgaggggtggtggatttcggagttggaccagcagctggcctagaggctactggggaggagggagcagggagcacccactgctgatccagattcactccttccctcgcctctgtcatgaccccaaagaagcagatcctgaacctgggctcttgtcttcacctttgttctcttccactctggggtaattaagaatgatttgctggccaggcgcggtggctcatgcctgtaatcccagcactttgggaggctgaggcaggtggatcacaaggtcaggagatcaacaccatcctggctaacacggtgaaaccctgtctctactaaaaatacaaaaaaattagccggtcgtggtggcgcgcatctgtagtctcagctactcgggaggctgaggcaggaggatggcgtgaacctgggaggcggagtttgcagtgagtggagattgcgccactgcactccagcctgggcgacagagtgagactccgtctcaaaaaagaaaaaaagaatgatttgctaattatgcaggcagctgatccagtgctgtgtaaccttgggggccaccagatgccaatcagtagaatgggagagaaggaaggatggaggaagtgaggacaaggggcaaggaggaaggtctgtccacctgtctcttttgtgcaggaggtgtccaagcaggaggagcacgtcacatccccactgaaaaagcccacagaaaatgaaaagcccacatgcttgtccattgctgcaggatgggggcaagtggagagggagaggtgtcaatgctcccaccttactcccagtcatggctgactcctccctttccttcgttcttgttcctaatctgtcaccatgtcctgtcgttttctttgtctcacccaaccctctgtgcctgcaaatcccctgactgcagcctcatccctgtcacctcctgactgtagttggtgacagaagaggaggctgcaccagtgaaggagcagggactccaggtctggcaacaaccagggat

SEQ ID NO: 92331 - DNA, 364 bp, Homo sapiens
cagcacaaggaatacttgcagagtggacttccctatggtaaaacagcatggacagctcccaacactgcaatcaaggacgcctctaaaagctttaatttaaaaataataataataataataagtctgcatgaagatgatggagccctctaaggcacatgggcttagagaattattcccatctgcaaccccctccccctacttagtagccctttccagggttatgattactggaaaatggctgttaatcaccagaattttttttgactgcagctgcttcagtcagactactaatctattaaacaacttcatcttcagtttaaaatttgcattgtaactgtatagaataaattttcattgtaatcag

SEQ ID NO: 92332 - DNA, 306 bp, Homo sapiens
aaggagatgatgaaggttaagtgaggtcataagggtgggccctgatccaacaggattcgtgtccttataagagaccagagagcttgggtgctacctccccatgggaggacatggtgagaaggtggctgtgtgcaaaccaggaagagaggcctctggggcttttagcctccagaactgtgagaaaataaaaccctgctgtttaagccactcagtcagtggtattttttagggtgcctggggctaatacagaaggattcaccctcctggggagaaggggccagtggcctcctctgattttcccggctg

SEQ ID NO: 92333 - DNA, 456 bp, Homo sapiens
agagcttgcagtgagccaagatcccgccactgcactccagcctgggcgacagagcgagactcggtctcaaaaaataataattaacaaaaaaaaatacaaaagttagatgcgcatgttgccatatgctcgtggtcccagctactcggcaagctgaggttgggagatcacttgagcccagaaggtggaggttgcagtgagctgagaacccaccattgtactccagcctgcgtgtcagtgagattctgtctcaaaaaaaagaaaagaaaaaaaatctaggctatgctccctagtatgggaaatctagtctagtcatttggcagaatcaggctttgcgggccatattgtctctgtcgtaactaccaactctgctggttaaaagggaagtagccacaaacaatgtctgaatgatggattatggctgtgttccaataaaactttatttgcaaaaacaggttg

SEQ ID NO: 92334 - DNA, 476 bp, Homo sapiens
gcttgctaagtcgcaggaaatgggaggtcgcagcacgccgctacctgcaagcccgaaagctgaatgcagctctagtgtggcgcgtagtcttactgggtactattttacttaatcgctgacgttgagtgagaggtgaccaagctcagatgctgagattaaggcggccgggcgaaactcgcgacaccctgcgattccctcttagccagctgcgtaaagttgcctacgccaagcgggtagcgtcctgctcggccacctggcggcgggcgtggagttggcaggcaggcagtgggggtcacgccggcatgaaaggccagatcacctgcaggtcgccaagttgccgggaatcccccgctccgagcagtgtcatgcccatcacaaataaccctatcgcagccgggaggtaagccctggcttccgagtaaaggccctgttcagagcagcctgggggtctagaagggaaacgggtggcgggttag

SEQ ID NO: 92335 - DNA, 487 bp, Homo sapiens
gaggaaggaatgggggcgagaaaggccaaagcattctgggggtagagaacaaagagtaaaaaggaccagcgaggcttctatctgtagatgggggaagaggaacatatgtgtcgtctagaacatggcatctcaggcagcctgctgatccaagtctgccctccccagcttcccataactgggccttctcctgcctgtcactttcactggctccccactgtccagtcaaataggagccatctcctcacaccagttctcaggaccccaccagccaggcctcccctaccaatctggccttaattctcacaattccctgcccactctccaagcctttgttcctattgcttctctcacttagaaatgctcctagaatgcacttccacatcccgccatgcagagactcccacgagtctttctcctctctcaacaactccaggaatctcccaattctccagccagaacgctgcacttgtctcaacacaccagtttc

SEQ ID NO: 92336 - DNA, 318 bp, Homo sapiens
ctgctcaggcatagatgaattgagtctacttcatttatcaagtgcattttttaaaatgtgtgaatgaatccactcagaccaacaagtttaagaagtaaattggtgttttctgtccctttctgatagccctgcaatataaatggggttgcaggtgcatttttggggaccacattttctgcttatgcttttctatttaaacactgctacacaatttaatgattttaagcatttagaagtctgctacatcagaaggttggtggttgggaggagttactattttatgagttcattctaatagaggttattattgtctgtata

SEQ ID NO: 92337 - DNA, 507 bp, Homo sapiens
tagttgtcccaacagaaaagatatatcataaaggaaaaggaaaaaaagttgaaatagacagtgactagatctgtgagatgaaggatttggttcatatgcacatgttcagagaactaagcatggtctagctgcagcaggggcatttaaacaagaataagaagtttgcaagtgagtctgatctgttttttttgtttttgtttttgtttttgtttttccatcagctagtcactatagcatctgctgtaagctctggttagaagttgatgagatttgtgatgtttaaagatgaagatctataaattatatctgtaggttatttgaactgtattacattactatggcagaaactagtagcagttcccctagatccatctttattgttaccaataaaatttttatctgagcatttcactgctcagaatagaggttaccttccctagtttgccttgcagctgtctgtgtccatataactaagttctggccaatgggttgtaaatagaaatatcc

SEQ ID NO: 92338 - DNA, 381 bp, Homo sapiens
catcctgctgagggcctctgtacagtattctttcctagaaaacaccctccccaccatcctcgctccccactgcagatcttacttgactaaagcccattattcttacaggcctcagttcagaggcctgagacctagagcaatgtttttcaaactgtgggtcatgacccattagtagcttgtgtaattaatttagtaggttacattgagcattaccgtcccccacaccctccagaaaaacaaagacaaaaagattaaaggaaatagaaaagaggctatctgagcacattagacaccatgaagttaagtgctgtttgttatgtggatgcgggatcatgatataaaaagccaaattcttactggtgattgcgattaaaaaaaaaa

SEQ ID NO: 92339 - DNA, 862 bp, Homo sapiens
tcacttgtgtagtttgaaaagggccacatacccacaactgagtttaacttatccctttctctgcgtccatctaaaaagtgtaagtgggcagctgtgaaggtatgtgcctctctccaggagccaagaggtctatccaggcaggagccattaacacctggtggagtagctgtggtcattgttggatataaaatgatacaaagcaggccaggcgcaaggtgggaggatcacttgaatccaggagtttgagaccagcctgggcaacatagcaagatcttatctctaccaaaaataaaaataaaataaaatggtataaagtaatcagcaatgtgtgtacagccaccgtttcaggcatgttgggggagggtgcagtggcaagctctgaatggacactccagtgtttgacagctaggcctgcgcagggttggtgaggtgctgtatgctcttgggccctggaagcagggtaaggcggtgtcgggtgggaaccgccccgtcagccactctggtatgttgctcggctgtgtctctacaacctgttcactagtttggaattgtgaaaaaaatgggtacctgagaattgaagccactgtccaaagaccaccctattggctttttgggacccaaattgatctcagatggtccttctagtgctaagaaatgtgctaaaaatgaaagtctggattggcactatactaaaagtaatataaaaccaaactgaaggtatacagttaaaactgagttctgggcagagtgcagtggctcacacctgtaatcccagcaccttgggaggccgaggagggtaggatgcttgaggttggtagtttgagaacagcctgggcaacacagtgagactctcatctctaca

SEQ ID NO: 92340 - DNA, 330 bp, Homo sapiens
attcagctctacggcagccagccgtcggcacaaggcctgagaggtgagctgcctgttccctcctcccccatttccagcctctctctaggaagccaggtgggctaagtagctacagaggctcaggtcctgagtcaagcacaactgagttggaatcccagctcttgaaatacattgtttgagtggcctttgccaagttactctcagagcctcagtttccctctctgtacaacagggaaaacagtgcttgcctcacaaggttactgtatctgatgaaaacagagcccaagtcctttgcccagtgtctcgcgcatccagggagagtgctcaatc

SEQ ID NO: 92341 - DNA, 606 bp, Homo sapiens
ctatctcattctcagggaaggactctggctctgcttgagtgatagagtgacatgttcaccccttggcctccaaaactgttgccaggagaattagggtgctatattgagcaagtgtactgtaatgggcagccataaggaatggaagaggtatcttgtccaaaggaattaggggtgcgagggaggcaagaataacacaacactctcagccgggcccccaccaaccagagacaaccagtgttcacatttttagtacaattcttccagattttttggatgcgtatacatatacatccttctgcagcccccagtcccgatgagcacatttcaaagtactaatcaaaaagtgagtgaagggccaggcgtggggaggccaaggtgggcagatcatctgaggtcaggagtttaagaccagcctggccaacgtggtgaaaccctgtctctactaaaaatacaaaaattagctgggtgtggtggcatgcacctgtatccccagccacttgggacgctgaggcaggagaattgcttgaacccaggagatggaagttgcagtgagctgagattgcaccattgtactccagcctgggtgacacggcaagactacatctc

SEQ ID NO: 92342 - DNA, 352 bp, Homo sapiens
gaagacaaaccagacagacatctgggaaaagagggttccaggcaggagaagccccaagtcagggctgtgcttggacttggaattgaaataagtcctggaaaattggttaatccccgcttggcatacatattatgtaaagtgtgttgggagaggtacttgaaggttttcctgttgaaataaattccctacaaccttagccttccagtccctctgcctgacactcccatggcagttggtgcacttgcgttttgccctgttgaagatgcctgtgccattagctcgcatttgttgggtatctttcttgcaccaggcaccatgctgggaactatgctattactgcgtggtcctcaca

SEQ ID NO: 92343 - DNA, 224 bp, Homo sapiens
acagtggccatatcttagcttactaccacctcaaactcctgggctccagaaatcctccagcctcagcctcctgagtaactgggactacatgcacacgtcaccacgcccagctaattttattttttagttttatttttgtatagaaacggtcttgtcatcttggccaagcaggtctcaaactcctgggctcagcaatcctcctgtcttggctcccaaagttcagg

SEQ ID NO: 92344 - DNA, 244 bp, Homo sapiens
cggaatctgggctccggctactagtgagtagacaccaggtgctgctaaacatcctactgcttattcgactgcccccaacaatacaaaattaactggtcccaaatgtcagtagtatagaagttgagatacactggcttaactagaattcttccttccacttcttaaaatttgctgccacggtagtcttgccagtgactgctttaataatttatcacagtatgcaaaatcgagtccgtactcccca

SEQ ID NO: 92345 - DNA, 384 bp, Homo sapiens
ccacaaaaacaggagataaataaatttatctttaggctagataattagaattcataaaggtatgccagagcacagaaaatatgtttaatgataactctgccttcctttcccatgatgtagtagagtctaagtgattggttttacttagggatatctgtatttgtttcttcactgatgtttctctatgtgtatgtatgcatgtgtcaggggaggggaatgggaagcaagtagaatgagataggcttcagagaaacgaaggcttaagaggtatacatatttcttaaagtcatccaaatgccgaagataaataaggccatggtaaattaagagtcgggttagtatctaaatatatgtacctaggaagacctgattaggatgaccctt

SEQ ID NO: 92346 - DNA, 496 bp, Homo sapiens
tcaggttcaactaacttattttcagagcttcttctgcaggcacacgcacacccgaatagctaaacaaaactggaagatggaaagaataaccatattaaataaagaagcgaacaaatagttctaacatggcaataatcaagagcaagtgaacgtagagtagttataatggtttactagaggtattcttttatgagaagtctatgtaacacattttgtatggtacattgtcctttggaatgaatcatctttcctgatagaaaattgggaaaatacaaggagaaataattgagctcagaagttagtactacatgtgtgcagttacatatctgaattggacttttgtctggaaagtaacaagcaaaataatagtaataaccaatacaccaaattaaaaagaagaagagaataatataatgtaaaaagaattttgcaatgtcgcctccatccacagacaactgtgaaacatcagctcaataaacgcatttcctttttaaaa

SEQ ID NO: 92347 - DNA, 271 bp, Homo sapiens
aaggatcacagagtggaacctcttcagaaccaaataacttcagaaggaatttaacatttttccacttaaaaaaattgttaacaggcattattattataaattagaatgcagttcatagagtgcatttctattgtagaagttgaatatgggtttcctgaggagcaagttacttgaatatattagacccttcttggtgatgttatttgctgtaacttctcctagattattttacaaattattctacattggatgtaatgttttaaaagtctta

SEQ ID NO: 92348 - DNA, 306 bp, Homo sapiens
atacaaaattaaaaagcaaatatgaaaaataatttcctgcatgcaaacaggcttttacaaaacaataaaagaaatactgggaaatgctcaaaaaatattaaaaagcaattaataaaaagaagtcagagctgggcacagtaactaacgcctgtaatcccagcactgagaggtggaggttggaggatcgcttaaccccaggagttcgagactagcctgggcaacatagtgatacctcatctctaaaaaagtaaataaactaattcacattttcaatttccatatcactattccaacatcaactacaat

SEQ ID NO: 92349 - DNA, 1576 bp, Homo sapiens
gtcttactcaagggctgtggaaaaggatagacatttatgtcatttaagctgtctctccccaccagacaggacttttgaacctctctaaccaacttttaaagaccattcacctcccataccctcccatcttattagaagggctcttgtcctttaacaggttttggcctataggtcaagggttacgtttagggttacatttaactgctagagtaacccatagcaaggctgaatataattggtctccttttaagtttccttgtatgtgagttagtagccttggtcactttctagcatcacaattctgattgtccatgaggtcttagagccttaaagaagtgatgattttaagcaaaagtcatggtgggtaagcagcggatattgctgcaagctgttactcttttcctccaggtttgcccaggaatcacagtgggacctgtttaagcactatttctccaacgcttgcagttggtgaaaagaaccaatgcctcgctatttggtgcacatggctttgtccgattcctagaatgccatgtgttaatgttacagaaaatgccagagggtatcttcatgcatattcctctagagcttcacagccaaacccttgaggtacctgtttctcagctgtcctttgactaacacctgattcacttagttctaccctatggtgctctttctaccacctgcatctcttccttttttcccttttactggctctgtttccctttactctttgaatcctttgtttctccacctagaaagtttctacctaccttatgtatccttcccgatattattgcatctagttctggactgggtttcttaactttccacctttgccagctgctacccagtatcattaaaatattaacatttagccttgctcaatggacctgtagtctatggttcagtctataatttgatacagctccctccagcccttctgagtctaaaacacattccaattcctctgttttccaggcttattttgccatcagtaactccttcctgttcccccagccatgagtgaatatgctgaatgaggacctttgtaagttctgatgaagtagcatgttaggagaatgaagcactaatcccagagctaatggaccttcctttcctttcagtactgtaaggagttcttctctcaatgtgtgacctgccctgtctatcaccagtgggtatctgagcttaaggcctctgtaatgagatgtgaaaagagagaattgatgtccctgactaacagcatcagaccttttgacacctgcttgaccaggatttggataaaaggagaatttctgcaggaaaataactcttagaaaagaaacttaggaatacagagatttgacagagtggctgatgtcaaggagaacaaggatgcagaagaaactcaagatgtatgtattaaaacaaaagaacaataacctgaagggaccatgattctgttattgtatataacacaaggaaatgccccagattctcctttaaaagatataatgtacatattaagtatactagcctttatagttactgctatctacatgtttatcaaaataaaagactatttttttctaaaaca

SEQ ID NO: 92350 - DNA, 1712 bp, Homo sapiens
gtcttactcaagggctgtggaaaaggatagacatttatgtcatttaagctgtctctccccaccagacaggacttttgaacctctctaaccaacttttaaagaccattcacctcccataccctcccatcttattagaagggctcttgtcctttaacaggttttggcctataggtcaagggttacgtttagggttacatttaactgctagagtaacccatagcaaggctgaatataattggtctccttttaagtttccttgtatgtgagttagtagccttggtcactttctagcatcacaattctgattgtccatgaggtcttagagccttaaagaagtgatgattttaagcaaaagtcatggtgggtaagcagcggatattgctgcaagctgttactcttttcctccaggtttgcccaggaatcacagtgggacctgtttaagcactatttctccaacgcttgcagttggtgaaaagaaccaatgcctcgctatttggtgcacatggctttgtccgattcctagaatgccatgtgttaatgttacagaaaatgccagagggtatcttcatgcatattcctctagagcttcacagccaaacccttgaggtacctgtttctcagctgtcctttgactaacacctgattcacttagttctaccctatggtgctctttctaccacctgcatctcttccttttttcccttttactggctctgtttccctttactctttgaatcctttgtttctccacctagaaagtttctacctaccttatgtatccttcccgatattattgcatctagttctggactgggtttcttaactttccacctttgccagctgctacccagtatcattaaaatattaacatttagccttgctcaatggacctgtagtctatggttcagtctataatttgatacagctccctccagcccttctgagtctaaaacacattccaattcctctgttttccaggcttattttgccatcagtaactccttcctgttcccccagccatgagtgaatatgctgaatgaggacctttgtaagttctgatgaagtagcatgttaggagaatgaagcactaatcccagagctaatggaccttcctttcctttcagtactgtaaggagttcttctctcaatgtgtgacctgccctgtctatcaccagtgggtatctgagcttaaggcctctgtaatgagatgtgaaaagagagaattgatgtccctgactaacagcatcagaccttttgacacctgcttgaccaggatttggataaaaggagaatttctgcaggaaaataactcttagaaaagaaacttaggaatacagagtaagcatttcttcctggaagccttgtgtgagagacataaagacagtctcagattcttactcacaagcagtcaaaggctgcacctctgaaataaaaagggacacacagatgtaaggagttagtccttgctccagaggatttgacagagtggctgatgtcaaggagaacaaggatgcagaagaaactcaagatgtatgtattaaaacaaaagaacaataacctgaagggaccatgattctgttattgtatataacacaaggaaatgccccagattctcctttaaaagatataatgtacatattaagtatactagcctttatagttactgctatctacatgtttatcaaaataaaagactatttttttctaaaaca

SEQ ID NO: 92351 - DNA, 111 bp, Homo sapiens
aaatcttctttcccatggctgctatttaactttgtaattgctgaggacattctttgtatttgtgacattctttgtgttccttctttcaggatttgacagagtggctgatgt

SEQ ID NO: 92352 - DNA, 216 bp, Homo sapiens
catgatgccctgcctacgtactggtattcttgattcattgttttctaaggacttgtcccattcaaacacatctgtgtacattagaattctgataatgtctgttgaggctcagagcttaagtttcaaagccatgtgcagtcagaagcaaggcaagaaaacttgggaagcacatttcataaagcctccaaatagagaaaaatcatagattaggaataa

SEQ ID NO: 92353 - DNA, 651 bp, Homo sapiens
ggcgacatctacatgatgtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgaggg

SEQ ID NO: 92354 - DNA, 447 bp, Homo sapiens
ttagttcccgggcctgctcaggccccccgccccggagccccagggcatgcagggctgtctctcgcgagataacattggcgtcggccgtgcatttgggaggggtcgttccccaacagcaggctttccaagatgcagcgctgggggttgcgaggtagggttggcgcccctgctcgatgttccacctctctgattgagcttctttctcccatcccgctgggaattcctccacgagttgggaccggattcttcgagcctcgtgcgaatggctgaggcgcgggtgtcagaggttttgcccctgcagtccctgcctgagtagtgttcgcgcgatgcccgtgggtggctgttggggtcacagtccctctccccgcctcaggggtgctgggatgaaagactagctagtcactacccttgtgtctttactcctcttctctgtccgggtcaaccagc

SEQ ID NO: 92355 - DNA, 344 bp, Homo sapiens
gccgttccaaatgtgggctgcttccggtgctcctttccttcctcctgccagcctctcactgtctacattctctggcgggaggcaggcaccagcctctatgttcatataaacccctaaattctagcttatccatgtcatgctctccagagagcaattccaccgtatccttctttagggacttaagaattgctgcaactgcttagcaagcccccagctgagcgtgagatactgttatgggttgaactgtgtttccccaaaattcatatgttgaattcctaacccttagtacctcagcaggtgactgtatttggagatagggtctgttaaaagaaaaaagtgattaa

SEQ ID NO: 92356 - DNA, 398 bp, Homo sapiens
aacaatgtgagatggagattctgtgtccgtgttctcattttctgggagagctgagtgacaagagaagagttagggacagagaagaccaatgacttctcttacaccgacagccccagttgggaaacactgtaataactgccagttttactttcctggacaaagccacttgagaattctgcagcccaagaattattttactcactgactccaccaaaacccgggtagaacacaaacagtgaccccagtgcaaaacctgtgtgtacgttatatacctgcatgcatgcatccacttctacatcccagcctctgtgttgcaactccctgggtctctggtcattccagagtaactcttgaagttctcaaagcccttacctctaaatttaattctaatgtagttt

SEQ ID NO: 92357 - DNA, 513 bp, Homo sapiens
ctttgaagattatgctacacacccacccacccacacacacatacacacagacacacacacacacagagcttctaatctactaacaggaacagctaacaatattttttgtaaatttttgcttccaacaagggttgctatataaaatgcaagatgcacatttaatttggatttcagaaaagcaccaaataatatgttttggtgtaagtatgtcacatgtaatatttgggacaagcctacatgcaaaaaattaactatttatctgaaattcaaattaaactaaatgtcttgtttcttgtattttttcttaatctgaaaaccctacttccaacgtctgttaatgaatgcatttagaagaggaagtatttcaatgaataagtagttctcaagatcctatcatgtagtttctaagaacaaagagatctctttaggtacttacattccactcaggatataagactaacatgtgaagaatgcaatatagtttaattgttaaactgtgtttactatctataa

SEQ ID NO: 92358 - DNA, 333 bp, Homo sapiens
ccaggaccaccagagaaagagacaacacccacattcacctaggaccatcagagacagaccccgcattcatcagaggccaccagaaacagacctccacatgcacccagggccaccagagacagaccccacatgcacccaggatcaccaagctgctgtctggaatgacactctgcaagtgttctaatttccccacaacttcagttagaagtatttttgactttcatactttttgtccgaatgatggttgtaatgcaatagatagttcgttttatttttaattttcatttctctgacagctggtgagtttgatcatttcaacatatttgctagccg

SEQ ID NO: 92359 - DNA, 421 bp, Homo sapiens
aagtatttgtatcagtttacttgctaaatgatagcagttataatagcaatttctggcttaaaaaaaaaacagggttaggatggaagggcaatagcatttttatactgaatcctaaaacatcagttataggcaagttttaaaacttaatcatacgttgcaaacacttgaagatgaaatggaaggcttataaggttaagtgttaggttttatgtgtcattctagtattggctgaaaagtgagtgctatagggatggtggaatgatgcagatatttgcatcattttctatgctgttatgcttctaaaaagaagaggctatgttttcctaaataggttagtagagtgcttctcaaggcttcccaaatgaaaagtcagacaaaaatatgtatttgttcttcagtgaagattgttgggttttcaaac

SEQ ID NO: 92360 - DNA, 794 bp, Homo sapiens
gagattcagatcttttcattaaggccaagtttaaaaaatctgtttaaacatgccaagaaagtaaaaattggcaaaattataggttttcctgtttttatattacagattacctgttggaattttaagtcttggatttgttttccctaaatagaaagtgcattactggggccagttattgtccactaaatgaatgaaaattaatttaaacattgtaaccttatggaaaatataattggaagggttaaattgttgttctttatgtccttgtacatcctctctcctgcactcatctctcagggctggtaggagtgggatagatgtgtgtttccaaaccgaatagaaatatatcttgatccatccatgattctgttctgtatattattgtgtggacattcatgagtctctaattcagtttgtcaaatatttacttaaatgtatatacagaacattgtagcaggaaatttaagaggtgcaaagaatgagactcatgtcttgttcttatggagctgtgctccagtaaaagaataacatgtatgttgtgtatgtgtgtctatgaatagctctaaaaatctgtgatagaaattatgaaaggcaaatagaagctgtttgaggttttaatgtcactcaggtggacattgttttcattctaacaacctgcagtttttgtttaccatgtcctggatgtggttctgtacagtgggtaatacaggtaagggtaagatatgcagctcctatatccaaggaaattctagtctaattggtcatattttagtgagaacagagttttaagagaa

SEQ ID NO: 92361 - DNA, 410 bp, Homo sapiens
ctttggttttctcttgccatgagttttgatgttttgttttgataattttcttttaatgtatctgtaatcttcatatataatgttaggtgaatacattgggtttctcttttaaatgcattgtttacccccaaaccattaaataaatattcatgtgctactcttttgaatggctttatcataacttatgtactgatatacagttgtctcttcctagaatatatttataacatttattaatttttaaattttattgcagtctggtatatctaaaatattactcttgccttattcttatcattaatggaaatccttgtagtatttcattatttgaaattatgtcaactttcgggttgctgtatcatgttagcgaagtatccttgtgttcctcctttgctagtcagattattatt

SEQ ID NO: 92362 - DNA, 366 bp, Homo sapiens
agctctattgcaaatatggtcaatgtgcctaaaaccagaagagctttctgtaagaagtgtggcaagcatcagccttacaaagtgccccagtataagggcaaggattcctcctatgcccaggggaagatgcgctgtgatcagaagcagagtggctacggtgggcagacaaaactgattttctggaagaaggctgaaactacccagatgattgtgctaaggctggaatgtagggagcctaactgcagatccaaggggatgctagccattcagaaatgcaaacttttttttttttttaagacagggcctcactctgtttctcaggctggagtgcaatcatggctcactgcagccttgacctccctagct

SEQ ID NO: 92363 - DNA, 312 bp, Homo sapiens
ggggattggaatccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgaatgctattcaggaggacagaccatggatgggaatcctgagccagaactccttagcctcatgac

SEQ ID NO: 92364 - DNA, 1078 bp, Homo sapiens
agcggaactgacttgaagatgtgtgattattttcagtaggcagacatctaaccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacattggttgatcgtgtttttgatgaaagcctcaacttccaaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcgagcatggagatttcttctatcttacaggaactgaaaagagtagaaaagcagctacaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagagtcaaccctgatggggaagaggaagatgttacagtacataaatgactttctcttgattgttgaaaaatcattacctgtggaatgactaggaatattggaagcagcatagtgttgacgtacgcaaaacaagacagcttggtcagctacaaaat

SEQ ID NO: 92365 - DNA, 1347 bp, Homo sapiens
gattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggttaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccaaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcgagcatggagatttcttctatcttacaggaactgaaaagagtagaaaagcagctacaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagagtcaaccctgatggggaagaggaagatgttacagtacataaatgactttctcttgattgttgaaaaatcattacctgtggaatgactaggaatattggaagcagcatagtgttgacgtacgcaaaacaagacagcttggtcagctacaaaat

SEQ ID NO: 92366 - DNA, 1317 bp, Homo sapiens
gattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggttaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccaaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcgagcatggagatttcttctatcttacaggaactgaaaagagtagaaaagcagctacaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagagtcaaccctgatggggaagaggaagatgttacagtacataaatgactttctcttgattgttgaaaaatcattacctgtggaatgactaggaatattggaagcagcatagtgttgacgtacgcaaaacaagacagcttggtcagctacaaaat

SEQ ID NO: 92367 - DNA, 330 bp, Homo sapiens
aaacatctcacattttaattatctgaaaagttgtaagtaacacaagtagaattttaaaaagaattctagagctagcacagtggtgcacacctgtagtcccagctacttgggtggctgaagagggaggatcacctgtaagcccagcacttcgggaggccagggcaggaggattggttgagcctaggagttcaagattagcctgggcagcaaagggagactctgtctctataaaaaatttttaaaatatcaaaatttttaatactacaagcacatgcctgtagtccagggaggaatgcttgagttcaggaggtgaggctacagtgagccgtg

SEQ ID NO: 92368 - DNA, 470 bp, Homo sapiens
ggaggaagggaaggaagctgtgcagtgtgtactgcttgcttatcaggaatcacgtcatttcctgtgtaaaggggctgtgtggtctccaggggcactgggaagccttggatggcatgatttcaccttcttcttgctcatcattgaggagctctcattagttaatgctagccctattcatttcatcatacatctattgtgttcatactgtgttctgagctccgtgtttaatcttcgcaggctcatgaagaggagttaaggatacttttgtcttgaaaatgctaacagtccctcatgtgcttgggaccagggctgctggaaaacccactaagcagcacacgggaaactagaaaagcagaggaacaaagttttggggtttttgggagagggggtgaagaatgacatattttattccaaaagcataaaatatttaatagtggaaactatgaatgatactgtttaatttttaggag

SEQ ID NO: 92369 - DNA, 389 bp, Homo sapiens
agtttattaagataaagctctcccaaggagggagtatgtctaatactgccaaaagatctagtaagatggagaagaaaaatatattcgcaatctcaaaactgggctcaagtgtgctccccagacctctgtcaggaagtagaaccaggacagctgctgggctccacatgcgacgagcccctaaatcataaatcgccatctggtacctgcttcactgtcactcacctcacaatagtgttttctacaaagattcctagacaaaataagtagacatgagagcaaatgtccccagtgtctcatgccccaacctcccctactcctgtgggcagacaagcacccgggggctgtttaccatattggaacattatattgtcacttttgtagtattcctg

SEQ ID NO: 92370 - DNA, 441 bp, Homo sapiens
ggtaaagagagataggaataggcaaatagcactttgcttcttagcaagaaattgcagcaggtaagtttggagtatagaaagaggaaagatggttttaagtgtttaagcaactctccaaagattacaaactttcatgagaataagtgaattttctggttcagagattgcagttgaaatctgttccaccttgtaggcaatttgatccatgccgaacagaaatgtaatagaggaacggaagggcgctaacttaagtcacgacttggattaaattgagaaattcaggtcttgttgttagaaagtatggctcccatctcataaacaattctgaatctgcagcctgcaagccccatcctgggcctgtccttgactgagtttgttcccatcagatactcattgcaaagcttttgggggacgtagcacttgtgttctaagcgggctctg

SEQ ID NO: 92371 - DNA, 291 bp, Homo sapiens
caccatgttggccatgctggtctcgaactcctggcctcaagtgatccgtccaccttggcctcccaaagtgctgggattacaggtgtgagccactgcgctcggccttaaaaattggcttatcttttaattcatcttgactcatgtttactgttttttggtttctgaaaaatagatttaataaataataacattttatcaaagttattagtatagagaaataaattgagtgttgttattattctatgatcatgatgacagcacagaagttaatgtggccagcatatagttttg

SEQ ID NO: 92372 - DNA, 481 bp, Homo sapiens
ggagaagcttaggagaaaaaataatggaacaagtatcaggaaagctggactccattccatacctgcctccaaccagctgtggaaccccaggcaaagttattttgcccctgagcctcagttttctcattgaaaaatcgagaatgactaggtgttcctttcaggctctaaaaagtagagacagagtttcatcacgtggccaggttggtttcaagctcctgacctcaagtgatccgcccatctcagcctcccaaagtgctaggattatagacgtgagcccccgtgcccagctgattttacattttcaattgtctgtttcactagattgtctgctacctaccttgtatcctctaacagatagtgttcagtcccctacccccaactctaaaatctaaaaaactctgaaaacagaagtttatgaaaagttgttacaaactcattcagaagcaaaaacttgaactgaaataaagacaatttaaaaatc

SEQ ID NO: 92373 - DNA, 1441 bp, Homo sapiens
atctaacaaggagaattggtttctcctaacaattctattatcttgtaggtggctgtgtccattcttaaaacttttggctcatcttaccagattttttacaaagatgcagatgttccttaaaagtggctgaaagattaggagttccttaaaagtggctgaaagattagggactttgtgcctgatgtgctggaatatgcccgagttctgttaaatctgatttaaccatattaaatcaaatcttttctgatgtattcttatgccctcattttcatgtaatgttactactatgaagaagtgtaattaagactttgatatgagccttcacagtctaaagagtgcttcagtgacaacagttttattagattatggtgatgggcctggctgtgaaattcccacattcatgaacgactctgctttttactggctaaaaacaggattttaaaatgcaatgacctttgggactctcagataagttgcctcttcaaccctgaggttatttgatgaattgctggggacatacagaaggatggattaatgaatgctgtgctcatcttgtctactggcaccatctgagggactgaagatcagggtgcctctttagactttggcttgagattacaatgttacccccctctttgctctagtaactccatcctctccactccatcactctctattatctctaggatgccgtaaagcacttacagttatttttcctcacagtggaaaatctctttatacaaactatataaactgagacccactgtccttatacaatcagggccaacctctttcccaccaaagactaattctgcccggatgcccaggatagttattttacgtacatacactatccataccctaatcccaagccaggtaaatatatatgtaatatccgaggtggatgtttttattacatggtgcctacatttagaagtataaaatctcttaattggttcccatcctgatttttttataaactcaagcttttcgggtctttactttgattttccatatttttcttttctctttgtacttgctaacagaactctggtttcttttcagataccatgcaaaaaataggctcagataaggcacacgtatgcccatgagtcataattcatctatccctttcatcataattccattctcctttgccagggattggtttagggacgggcatgtgactcattcaccaaatgaacataaaaagaaatctgttgggattgattttccttttgtaaaaaataaaagagacaaactcatgaggaaaatctcatgttcctccatgtttttaaatcttatttcatgaggatgggggcttggagttgtggcaacaataacagagaagccaagagaatcctaaaaaagctgacccagagatgtgacatttgtgagatgttaattaaccaccttggaaactgtcacttctagacttctt

SEQ ID NO: 92374 - DNA, 818 bp, Homo sapiens
aagaagtaattatttatttggaagcctttctaatcagagtttttggatactgtgtcagaaatgaaaactattgatgtagtcttttttacgatgctgtgattttggttattttccaagtttagtagcttgggttcctttcagcatgataaaagcatgttaaatgtcataaacatgaacctaaacagcagggaaaagcactgcagcaatctgcaaggatcttaagcatgcttaaatttgtcatcacctaagagtcattcttcaggcaaaagcaagctggtcagtgctctaacactgagatagggcaatggcagctcctggagggttttattataatatctggagatggacaatagaagacaacaaattaggcctcagccagtgagggaaacaggaagaacttggccctagagggctccagttttcctgggacatgctgagaaaaagagaataacagcaacagtaacaaaacaaaacaaaaacaggccagggactggaagttaccctgcaagtaaacaggtgctgaaaagtcatctactcaactcaggatgacttttggtctaaatatgcttctgtttcaaccctctctattatggtcattgaaagggtattccattttgctcagagaaaaactcaactgctgctttccatttttatggtcttttcctgtttcccaagagaatacattggataatttcataactcagaaaaatagcattgaatctcatcttaactaattaatcactgtgaacaaatttcttaacctattatttgggcctctgatgctcagtttgtaagaaagggagtctttctaggaatta

SEQ ID NO: 92375 - DNA, 467 bp, Homo sapiens
gagcttgtacaggtgtaccctctttataaaacctgcaagagaaagacaggacttcttgagatgatgacaaacctacagttctatttctgaggcatcatggttataggaagtattaagcacctaagtttaaaacagaaaaggaaatgaaaaatgctttttgtaatttactttttactttatgacaagtttagatttatcaaattattgtgaagatggtacagaaatctcataagccctagactcagtttcccctattattaacatcttgtataagtatggtacctttgttataattaatgaactaatactgatatactaaccaactaaagtccatactttattcaaattttctcagtttttccttaagttacttttactgttccaggaccctatcctaaatgtcacattacatttaggatacagtctttttaggcttcacttgcctgggacagtttctcagactttgt

SEQ ID NO: 92376 - DNA, 2583 bp, Homo sapiens
  misc_feature (1010)..(1010): n is a, c, g, or t
  misc_feature (1342)..(1342): n is a, c, g, or t
cttttagtgagagtaactgccaaaatatcaaaagatcctttaattatcaggtatttgaatccaggagttctctgcttaaaaagaataccagttaccagactattgtatgagtatttaaaaaatcaggaaaagcagcaaaaacagatttcaaagttattatattcattttaaaaaagtagattcttgaaattaatattagtggaaagcaatatttcaaactacacccatttcatttatagtatatgacgaattatgtagccacggctggccttagggaaacttggggcgtaggtagttctttctggtgttctgcttggctgtgttgtcaggaggtttctttttctcagtctcctagggttgcccacggctttctgtcagtctggtggcttacaaggcttcacactctctatcctcttccagaaccaagcctttctctttcctccctttcttttaatatataacatctgcatctagaaaaatgtccttgcatttgatagcacaatagattaaatgagatacaaattggaaataaacaggtagtcttggtgggaaactctttttaggtaggagtatcattcccagggccttagatcaagatctagaagctataaagggttatagtggtgttgtagaactttgtctttagttgagctaaaaacggggttctcgtcacacaaccatgacaaattaggctcacagacactttgaagggtgaccaggacagggtttattggatgaaaagggaaagaaggactatcagcaaagcgagaagccggctagccagttttccacctcgcacactgaattccaggttactatgctgcaacaggagaggccaggctcctccccactgcaaaaggcgtgaacttcctgaggctccaccccagtgcgcattcctcccagtgctcaggcctgtgggagcttctgccagggagccctttttacttggctgtctcagtagtagtgacagtgatgttaatagtatgttcgtggttcctcaagcacactancattttccttagatagagccctcgtaatattttctctccttgaaacactaacctattctccttttgccattgtcccgtgtgcctcgcggtattagcattgtggacactgaaacctagtctaaactagcacaagcaaagggattttcttgactcacaaaatgaaagtccaggagcatattaggccttaagcacagatagatccagggctgaaaccatgtctcatgtcagcaggacactcttactatcttaaaatctcaactctgattttctctcttctcatctcattccttttctttttctaacatttattttaagttctggggtacaagtgnaggtttgttacacaggtaaacttttgtaacggaggtctgttgtacagattatttcatagcccaggtattaagcctcgtgcccattaggtgtttttactgatcctctccctccttccatgctccaccctccaaaaggccccagtgcgtgttgttgccctctatgtgtccgtgtgttttcatcatttaactcccacttataagtgaaaacatgttaagtatttcatgttagtttgctcaggataatggcttccaactccatccatgtccctgcaaaggacataatgtcgttcttttttattggcctaattcttaggcagtcttttctggaattgtgacagaaaaggttcaaagcagttattttttttcatattatatccatagttgtgtttttattgcaaagagcacgcctcttactggatacctcctatcactattgatagggaaataaggtcatctcattgactagcgatgaagcctgttaggttaccccctgtttggagtaggcagagggatcagttcacaagaatcttttggagcagattcattttaaaacataaaaaattatgttaatagaaaggtgaacaaaaagcatatttgagaggcaaaactatggctactactgtttgtgacaaaaattatcaaaagttatacttacatatgggtttctgtctgtcttctcacctatagctctgtgaaaaataagtgttgctcactgctgagtactcttacaagtgtgactggctggggctggtgttgccggtggtaaaggaatttaccaagacagttgtagggggagaaaaataaaggcacatttattagagaaagtatgaaaattcattgcaagggtgcaatatgtagcactacagagaaggggctgtctgcaaagaggcaggggctggagggaagttttataaggtcttctggagggggctacatgctgatcgaggttgtgccatttgggctacctgtggagcaaggtcgttgtgtcagcgcgttgtttatggttacttgtctctcagaacaattgttctctcctaccttgggcccctccctggtggttatcaagactccacaaatatccagtgcctcttgcgctttaggatatatattaagaagtcactggctgtgcacggtggctcacgcccgtaatcccagtactttgggaggcagaggctggcggatcgcttgagttcagaagttggggaacagcgtgggcaacatggcggaaatcccgtctctac

SEQ ID NO: 92377 - DNA, 274 bp, Homo sapiens
ggggaatgttactattctgctagcattaggggaccaggaactagcatttacgctttcactgcaggtgcctgggacctaagattcctctttcactgaacctcgcaggaactagttcccctcccttccccagcctggtgatccagctgggcagactaacaataacttagtagcgaccacatgcctggcattttaccttatttaatcctcacccctggatgatgatgctcactattcccatgcagactcagctgccataaaaccattggagagcccc

SEQ ID NO: 92378 - DNA, 1226 bp, Homo sapiens
ctacaggatgtgatgtgagcgatgccagacagctctctctgaccccaggtaatgccctgaatctggtgatcctggctgatctgtgaccaatagagattagctccttgggatttggggtcctaaaaggtccctgaaaaaatgcaccccttgtctttaagccaacattggtgaaggaactgagaactcttagggttacataaaaaaagacccctgttgagatagtttatgcagatacctggaaggaactagagatgccaggaggaagactgagacccagaatgaagcaaggcatgagggctccaaagtgaactgcaccatcccagagtctcagccaagatggccctttcctagagggacgggcaccttccacctgcccacaggcactgctacctatgggaattgcagaaggccgttgtacacacgcgcatgcacgcagtggccctctgccctttagaatatggaagcaaagtctgggtgcagtgactcacacttgtaatcccaacactttgggaggccgagacgggcagatcacctgagttcaggagttcaagaccagcctggccaacgtggcaaaaccccatctctactaaaaatacaaaaattagctgggcgtggtggcagtctcctgtaatcccagctacctaggaggctgaggcagagagagaatcgcttgaacccaggaggcggaggttgcagtgagctgagatcgcgcgactgcactccagcctgggcgacagagggaaactctgtctcaacaaaaaaataaataaaataaaaaataaaaaaagaatatggaagcaaatggagaaagggaggaaactgaggtcaggcaaaccttccagcaatcagttctgcccagagaacatactgacgacagagaacacactgagcgtatctgcttctagttagagcattgccgattgccttcataattcataatgtgctgtgctcctctgagggtctatctgtatttctcttcaaagaattccctttttaaattcttgcagctgggttttaagacacaataatggggcaaattaagttttataaacttggagatttttatgcagtaaataaaaaaataatatgtactagtcacccctgaaactgcattcttagaactcgactcttgttttatttaaatacgtgcgtagatatctgtgaagattttcatgtacctatttaccttgtcactaataaaattaaaactgaaagactaaaaagca

SEQ ID NO: 92379 - DNA, 543 bp, Homo sapiens
ggcagggtgatgagcttccacaaagaaaagcagtcttccaaggactagtttttcctccaagggtctcagcactgaggtgacatttataactttctgacttaaagtcaatcccattgttctacgcagccccacattcctccctcagaaggagccctaatcgatgtggcatggaagaacttgtggtcctcttggcagccaccccaacttccgttcaggcctccgcacctcccccagtgttgtggggcactgaccgcctccccagaagtggcccaggctggaggttattgcctcatcctctccaatggccatggtcacatcacagcataggccagcgattcagtttgggccaatgaaacacagggaaaggtttgctgtggcttctgggagaatagctccctcacttctctgaaagagcttccagaaacacatcactcactccaaacaaggctgaatgtattagctgtttactgctgcttaacaaattatcccaaaatttagtggcttaaaacaataaatgtttattatctcacagcttccgagggt

SEQ ID NO: 92380 - DNA, 273 bp, Homo sapiens
cagaagcattgtttcttctgggagggtatccatttcacccccaaacctttggattttattttgtgttatttatttatttttgagaccagcctggccaacatggtgaaacctcgtctctactaaaaatacaaaaattagccaggtgtggtggtgggtgcctgtaatcccagctactcaggaggctgaggcaggagaatcacttgaacctgggaggtggaggttgcagtgagccgagattgcgccactgtactctagcctgggcgacagagtctc

SEQ ID NO: 92381 - DNA, 369 bp, Homo sapiens
tatgagttgtactaaccataatagttgtaaaattgtctagggaaagtcaggaagcatctttttatctgtctatatgccacagaactattcttgatcatggagtatataacctgcatcagaatgacatcggattaatctctgtgcttgtttaaacacagagtatagagttctagccagaaatagtgaatcaacatttccagtggtagatcccagaaatggatatttaacaagcatactaaataataactatttccaataaagcttgagaacaactgcctcacagtccctgccacagtgcctccaaacatgaggcatttaatgaatgtgttctgaagtgcaagaatgcctgcatgtaatccacacatctct

SEQ ID NO: 92382 - DNA, 391 bp, Homo sapiens
tctgtgctttcgttgcttcacatacacacacacacacacacacacacacacacacacacacacacacgaaaggggaggttggttagataaataacactaagctggtaatacagtaatgtatttgttgacccagaagcatatttacaatattaaataaaaaaataggttaccaatggcatatattttatgatcctatcacagatagaaatatctgaaaatattgtcaagtcaagcagacatcacagacaaaagtgaattagaaattaaaggaatatgaatacatataacaaaataaaaacaacaaaacttcaaatctgaaaaaagtttataatttgttgattaaagtttcttatattgttttcttattagaaaatcagtatattctctgcag

SEQ ID NO: 92383 - DNA, 3076 bp, Homo sapiens
caccagccgacccgtcagtgacaccgctgtgccgtccccaaaaccagccgagacagctggcccccacccttccacccattgggcaggccgcacgggggcgcggcccggagtcctggtccctttgttgggcgcgcaccccctcccttaggtggcaacaaagtcgtgcagtgggagccgccgcgatagggcggggagtggccagggcgggactccaagaactgcccgggggcagcggggccaaaaagtgggaagaaggaaaaaaggcaggaggcatctggggacaggcgcgagggcagccggctctgaagtatgcggagggcctcctcccggccccgggcattcgcggagaacgagcctcgcagaagtttggctgcagctgcccgggcggcgtcgatggctgcgcgccccgcgccgcgcgggggctgagcgggcgccacttcccctccgggccggcttttgtgtctggcatctcctcctcatgctgcgtctggccacctactgcggcggccgctgctgagacgctcgctcggaccaaggggaggagacggcgggggcggccgcggctttgggtccaggcgggactatgggaaacgggatgtgctcccgaaagcagaagcggattttccagacgctgctgctgctgaccgtcgtgttcggctttctctacggcgcgatgctctactacgagctgcagacgcagctgcggaaagccgaggcggtggcgctcaagtaccagcagcaccaggagtccctctccgcccagttacaagttgtatatgaacacagatcaagattagagaaatccttgcaaaaagaaagacttgaacataaaaaagcaaaggaagattttcttgtttataagttagaagcacaagaaacattaaataaaggaaggcaagattccaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacaccaagacatacatacacagcttcaagatgtcaagcaacagcataagaatttactctccgagcatgaacaacttgtagtgactttggaagaccacaagagtgcactagctgctgcacagactcaagttgcagaatataaacaactgaaagatactctgaataggattccaagccttcgaaaacctgatccagcagaacagcaaaatgtgacccaggtggcacattctccacaaggttacaacacagcaagggagaagccaacccgagaggtgcaggaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttgaggagggccggccgcagcaccaggagcagctccggcagcaagctcattatgatgctatggataatgatatcgttcagggagcagaggaccagggaatccaaggagaggaaggagcctatgaaagagacaaccagcaccaagatgaagcagaaggagatccaggtaatagacatgagcctcgtgaacaaggaccccgagaagccgacccagaatctgaggcagatagggcagctgtagaagatataaacccagcagatgaccctaataatcaaggtgaggatgaatttgaagaagccgagcaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggaggttcaggaagatttgactgaagagaaaaaaagggaactggagcataatgctgaagagacctatggtgaaaatgatgaaaatactgatgataaaaataatgatggagaagagcaagaagttcgagatgacaaccgccccaaaggccgagaggaacactacgaggaggaagaagaggaggaagaagacggggctgcagttgctgagaaatcacatcgaagagctgaaatgtagcagcacccaatttctagacaacgctcagccaacggattcttttcaagctgctcaaacataaatctgcctactgaactctaggatatttaattacaaaaattaagaacttagacttttttaaaactttgtattagaaatgcgcatacatttatatgaatatattttgataacataggtctagagcttcttttatattcaagctaaacatgaaaaagaagaaaaacaataaagtaaacctgagcccccacgtcccaatttttttaatagattatgtgatgttggaaagctcattgatttgtatatgtttcagtgtgttacctttctggcttccagttcccaggtgttctttgtttgcctttgataaaatacaggatttaagaacagaaagtagctgcaaaatgc

SEQ ID NO: 92384 - DNA, 3008 bp, Homo sapiens
caccagccgacccgtcagtgacaccgctgtgccgtccccaaaaccagccgagacagctggcccccacccttccacccattgggcaggccgcacgggggcgcggcccggagtcctggtccctttgttgggcgcgcaccccctcccttaggtggcaacaaagtcgtgcagtgggagccgccgcgatagggcggggagtggccagggcgggactccaagaactgcccgggggcagcggggccaaaaagtgggaagaaggaaaaaaggcaggaggcatctggggacaggcgcgagggcagccggctctgaagtatgcggagggcctcctcccggccccgggcattcgcggagaacgagcctcgcagaagtttggctgcagctgcccgggcggcgtcgatggctgcgcgccccgcgccgcgcgggggctgagcgggcgccacttcccctccgggccggcttttgtgtctggcatctcctcctcatgctgcgtctggccacctactgcggcggccgctgctgagacgctcgctcggaccaaggggaggagacggcgggggcggccgcggctttgggtccaggcgggactatgggaaacgggatgtgctcccgaaagcagaagcggattttccagacgctgctgctgctgaccgtcggtggcgctcaagtaccagcagcaccaggagtccctctccgcccagttacaagttgtatatgaacacagatcaagattagagaaatccttgcaaaaagaaagacttgaacataaaaaagcaaaggaagattttcttgtttataagttagaagcacaagaaacattaaataaaggaaggcaagattccaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacaccaagacatacatacacagcttcaagatgtcaagcaacagcataagaatttactctccgagcatgaacaacttgtagtgactttggaagaccacaagagtgcactagctgctgcacagactcaagttgcagaatataaacaactgaaagatactctgaataggattccaagccttcgaaaacctgatccagcagaacagcaaaatgtgacccaggtggcacattctccacaaggttacaacacagcaagggagaagccaacccgagaggtgcaggaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttgaggagggccggccgcagcaccaggagcagctccggcagcaagctcattatgatgctatggataatgatatcgttcagggagcagaggaccagggaatccaaggagaggaaggagcctatgaaagagacaaccagcaccaagatgaagcagaaggagatccaggtaatagacatgagcctcgtgaacaaggaccccgagaagccgacccagaatctgaggcagatagggcagctgtagaagatataaacccagcagatgaccctaataatcaaggtgaggatgaatttgaagaagccgagcaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggaggttcaggaagatttgactgaagagaaaaaaagggaactggagcataatgctgaagagacctatggtgaaaatgatgaaaatactgatgataaaaataatgatggagaagagcaagaagttcgagatgacaaccgccccaaaggccgagaggaacactacgaggaggaagaagaggaggaagaagacggggctgcagttgctgagaaatcacatcgaagagctgaaatgtagcagcacccaatttctagacaacgctcagccaacggattcttttcaagctgctcaaacataaatctgcctactgaactctaggatatttaattacaaaaattaagaacttagacttttttaaaactttgtattagaaatgcgcatacatttatatgaatatattttgataacataggtctagagcttcttttatattcaagctaaacatgaaaaagaagaaaaacaataaagtaaacctgagcccccacgtcccaatttttttaatagattatgtgatgttggaaagctcattgatttgtatatgtttcagtgtgttacctttctggcttccagttcccaggtgttctttgtttgcctttgataaaatacaggatttaagaacagaaagtagctgcaaaatgc

SEQ ID NO: 92385 - DNA, 2954 bp, Homo sapiens
gcgccgagcgccgccgccgccgccgccgccgccgctccgctgcccgcgccgcccgcggctcccgatggagactgacgcgccccagcccggcctcgcctccccggactcgccgcacgacccctgcaagatgttcatcgggggactcagttggcagactacgcaggaagggctgcgcgaatacttcggccagttcggggaggtgaaggagtgtctggtgatgcgggaccccctgaccaagagatccaggggtttcggcttcgtcactttcatggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgaattccgtgtagagcggacccctctcccgagcgccccagtcctccccgagcttacagccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttgggggccctttgattgccacagccttcaccaatgggtaccactgaagcaggggacggtggcaggagcgccccagcctgcagctgactgaggaccacgagtgagccagcgagggggcgggagacctcagccgcagccgccgccccctcccctgcagcgactcggacccgctactgcctgcccccaactccccgggcccggcccctgccctgctgcccccaacagcgtctggctcccctactaacgtccccctcttcgcccttgcccccatccccacccgcccctctcccggccctgcttttatttattttggattagccggttgcccaccccagccctctggtccatccctccctccgtgccgcgcccccctaggaccgccccctccccaaaaggcttttggatttgtgcatagctggagtgaaggcggagggagcctgctacaggccgcagcccaacccctgttttttattcagatttcccctcctttaccctttcccttttttttttttttttttttttgtttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctccgtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcctaataaattatttgaaaacgtta

SEQ ID NO: 92386 - DNA, 198 bp, Homo sapiens
gaggctggtgaagaagagggagaaggagaagagagactgagggatgaggggaggaaggaggcgagagagatccttagtgatagtattctgattggtcagtaatagcttcaagggaggctcagcctctgtagcacctatggttcaaaaaaatcatgaggctgtctgttaggctgttcttacattgctgtaaagaaatat

SEQ ID NO: 92387 - DNA, 330 bp, Homo sapiens
ggaaggagtcatgtgggcaccgagttttatgctgtattgattaactttccatttcccttggttcaattttagtttctctcttagaattatgtttctaccctttgcattctcaccgccaatcatttattgctgcacgtgtctttccccctccatatactgtgctccttaattcactaagggactgtactaacatagcctaaatacccaccttccagccacccttcaggagggtattagctgtatttgtgcacagcgagagtgccttcaaggcagagggcttcctcccctatacttcacctccaaatctctttcctttccacaaatccttag

SEQ ID NO: 92388 - DNA, 442 bp, Homo sapiens
tcaagcccccaagggcataaaacaaggtggagacatcatccagtttttttgtttaagggacctgtattcaagtttgttactgaccaacttgctggcttgtctggaaaagtgggcttacaggtgttctaagcccgtgttttaccctgaagtacccctcgacacagaacgactaattcatagcacaaaatacaccagcttaagactagccttagaattctttttcgcattaatcaaagctttacagaggagataaacgctgattttttttttaaaccattcatggacccgtttgcacagagaggaagaagccagaaatctgactggaaagaaattcttacccttttgtcagcatgccaggcttctggattccctttccctgagcggccccagtgatccagcttgcagcaccattgccctgggggccaagctgcatcataaagga

SEQ ID NO: 92389 - DNA, 314 bp, Homo sapiens
tgtagccactgacactactgaccacattgttaaccttttctaccttagcacctgtaataccacaccatcctggctttcctcccacatttacggtcattcgctctgtgtctcctctttgtctccacccacccccaaatgttgatattcttcaagtttcagctgctgccctctcttttttcttgacaagctcttgatagcagatgacctacagatgcttagaatatcaacaatctttcttctctagatgaacagctcccacctgtgacttcatttccaattaccaaaactgttttttctgtctggatgtggattag

SEQ ID NO: 92390 - DNA, 470 bp, Homo sapiens
aattattgcacatatttttataggtgagattggcctataatgttctcctttactgtctcatccagctgtagcctcctaaaatcaatgtaatttttcttctttttcatgtttctgaaacattttgaataagattgtaacataaaatttatctatagtgaaaatatgttacgattctaggctttcttttaacatctttcttagccttagatttcttttatcttttcaaaatggtttttcaagaaccattttgtatgaaagagatttggatagcactttgtccggtactggatagcaccatccagtagtttactggttgtcttcacctaaaatccagggagctttggtccgaaaccaaggcttatagtatctgaagacgtttctcagtgacactggggacctctcggagcctagtcagtgggtttcctcctgcctctcagttcttaatagagccctggctgagtgccttatat

SEQ ID NO: 92391 - DNA, 476 bp, Homo sapiens
cgacagagcgagactccgtctcaaaaaaaaaaaaaaaaaatttacctaaggaatctccatctggattggcatcatttatttttatatattactctcatttaccccatatgaaaacagatagcttctagggacctatacccagcattaagcttttccatttcattgtgtaaataattccaactcttttaacctgtcctcagaaatttcaagtccaaccaacttcatgacttttttctgaaacttttaagatttcttttcctctaaactgtagggtcaaatatgatactcagatggggaacttaatattactaagtaggaggaaattacatcagtttccagtacatctacctgtggaattaaaattgtggtggctcatgcctctaatcctaacactttggaaggccacggtgggaggatcacttgaggccaggaggtcaagaccagcctgggcaacacagtgagaccccgtctctaca

SEQ ID NO: 92392 - DNA, 364 bp, Homo sapiens
acctctgcctcctgggctcaagtgatcctcccacgcagcctcccgagtagctgggattacaggtgcatgccaccacacccggctaatttttgtattttcagtgtagacagggctacaccatgttggccaggctggtctcaaactcctgggctcaagcaatctgcccacctcagccacccaaagtgctgggattacaggtgggaatcaccacacccggcctaggaaagcctttttcttccagagttgccactgctttggaactgcatagactctgaaagcagacttcctggattcaaacccaagctttgcctcttaccaactatacgacctcaggcagatcacttaatccctctgtgcttcactt

SEQ ID NO: 92393 - DNA, 530 bp, Homo sapiens
gtgtgtgtgtctaggtgtgtgtgtccaggtgtgtgtctctaggtgtgtgtgtctaggtgtgtgtgtccaggtgtgtgtgtctaggtgtgtgtgtccaggagtgtgtgtctaggtgtgtgtgtctaggtgtgtgtgtccaggtgtgtttgtctaggtgtgtgcgtccaggtgtgtgcgtctaggtgtgtgtgtccaggtgtgtgtgtctaggtgtttgtgtccaggtgtgtgtgtccaggtgtgtgtgtctaggtgtgtctctttgtgtagagctttttgggcttcttgaatgtgtaggttaacatttttcagcaaatttgggagcttttcagctattatctcttggacattttatctgcttggaactttttttctgcttctttctctctcacatctcctctggtactctcattaaggatgtcccaagcttctattcatttttcttaattatttatccctctctgtttttcaggttgtataatctctattgacataacttcaagtctgctggttctttcttctgactgttc

SEQ ID NO: 92394 - DNA, 740 bp, Homo sapiens
gctaatcaaaattccacggagtacccttgaaacaattgcatatataaggctgtttctcacttaaaagagacaatgcagtgtggggtgaattgtcttttgaagaactgtatgacacatgcccagttcaggtgaaaggtgagaaatggaatgtttctcagacctagcacagacacctagggacctagtttgggaagcttatcttgtcattttccttgccaaggataagtagaggatttcagctatcaacattgctaatccgttacctttcatgctgagcaatgtctctgccttcccacagacttagacaaagcttcttattttcttacaaagaggtcctattgaggaaatttgaattttttttttttttttaaacttagcagtactacatcctgtgcttttagataggtgagcaattttccatgttaacagctaggccaaaaatcatgactgccagtagaagtgggtaactagatagatagatagatggcctttgatttagcactgatgatagttattagcatgtagcaacttaagtaaaagcaactggaaaggcttgatagaaattctgagttgtttgaagtataatagattattaggatagtaatttctttgtgaattttactgtaaacaagcttgattctagtgaggacttatgctaattgctcacttatactaacagcaactacagagtttttatttaatactgtttcttatacaaatatcatcaaatgcacatccac

SEQ ID NO: 92395 - DNA, 721 bp, Homo sapiens
gctaatcaaaattccacggagtacccttgaaacaattgcatatataaggctgtttctcacttaaaagagacaatgcagtgtggggtgaattgtcttttgaagaactgtatgacacatgcccagttcaggtgaaaggtgagaaatggaatgtttctcagacctagcacagacacctagggacctagtttgggaagcttatcttgtcattttccttgccaaggataagtagaggatttcagctatcaacattgctaatccgttacctttcatgctgagcaatgtctctgccttcccacagacttagacaaagcttcttattttcttacaaagaggtcctattgaggaaatttgaattttttttttttttttaaacttagcagtactacatcctgtgcttttagataggtgagcaattttccatgttaacagctaggccaaaaatcatgactgccagtagaagtgggtaactagatagatagatagatggcctttgatttagcactgatgatagttattagcatgtagcaacttaagtaaaagcaactggaaaggcttgatagaaattctgagttgtttgaagtataatagattattaggatagtaatttctttgtgaattttactgtaaacaagcttgattctagtgaggacttatgctaattgctcacttatactaacagcacaggatgtagtactgctaagtttaaaaaaaaagtcgacgc

SEQ ID NO: 92396 - DNA, 247 bp, Homo sapiens
actatgctcactatctgggtgacaggaacattcatatgccaaacctgagaaacacaaaatgtacccatgtaacctgcgtatgtacccctgaacctcaaataaaagtaaaacaaagcaaaacagctttgagccttgcctataagcccatttattactcctggtgttccagaagtggcataattttaaagaagaaaacatgagaaatttaaaataaaatgcttcctggggcataatgtcatcctactcc

SEQ ID NO: 92397 - DNA, 475 bp, Homo sapiens
cagagcaagactctgtctcttaaaaaaaagaaaaacgaaaagtagttgtctgtggttccctaaaaatagcttcaaaacgcttggagttttctgtgtgatgggaatggttttgttttactgattagatgactcactgtgggccattagatagctttaggatgggaactgccctccaaaaagaccaggaataggattagagggttagaactttcagccacttgccctctagggcgggaaagtttggagattgagttcagttatgtgaccaatgatttaatcaatcatgcctaagtaataaaactccaataaaaactctgctcatggagacttgggggagcttcctggccggagaatacatcaatgtgccgagagcgtgtcatagcctgactgtattgggagaagctcttgtcctggactctcccagactttgccctatgtgtatcctttaaaataaaactgtaataataagtatagc

SEQ ID NO: 92398 - DNA, 549 bp, Homo sapiens
aacctgattaaagcagcagtggctctgaacaggaattccccaaaatagctcagctgatgattcacaatcttataaagcaggctgaacaagacctggactccggcccccatgcagctgccccgtgcctgggcgaccttgagtggctcccttaatatatctgggggtcacttcatgtttcaataaagagcctgcaacctagagggagaagacagacaagcacgcatgacctaaaagaggtgctgagggaacaacacagctcagaaaagagagcaggttcgacctcggcatgtgtttcatttttttctttccttatttgctgacagcatccatcctggctaacgggatgggtgatttttttctgaagttccagtgtgtttagaaaaacaaagactttttaagataacaggaatttttaaatggtggtatatttaaaatgtttacactcaccagattagtatttttatactaacaaaaagtgtgatgtcacataagtatgttattcgaaagataaatacacaatgtatttctaagtattttttatagcacatg

SEQ ID NO: 92399 - DNA, 391 bp, Homo sapiens
gcgaggacggactctctcttacggtgtttcatggatacatacagacccatccacggtcagatgcaccatcattatttttataccacgaagaaaggtgaaacactgccaatcaagactatgacactaaagtcaaaagccatcaatgataagacaatcctgatgtcagttcaactgtcagtgagaaatgtgcatcttggaatccattaaatatgatttcactcttacttacattgaacaagtcatttaacctggagcccagtttctgtatctataacatagagggctgaatacggtgattactaagatcacttccagtttgacaatgttcgatagatagaacaggggtgaggagaataaagtctctagggctcaaaatttaatgaagcactaa

SEQ ID NO: 92400 - DNA, 633 bp, Homo sapiens
agctctgagaatgctcatgcagaggagcatgcccctcctgcagctccagggccccatcagttgtgtcattatctgagacttcctcgggaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaaaaaaat

SEQ ID NO: 92401 - DNA, 376 bp, Homo sapiens
aattcaagcttctaacgatgtacggggacatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaaaaaaat

SEQ ID NO: 92402 - DNA, 3958 bp, Homo sapiens
  misc_feature (4)..(4): n is a, c, g, or t
  misc_feature (10)..(10): n is a, c, g, or t
gggnggagangagcaggtccgcgacgctgctgctgtgcctgctgggctgccacgtctggaaggcggtgacaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaaaaaaat

SEQ ID NO: 92403 - DNA, 3904 bp, Homo sapiens
  misc_feature (4)..(4): n is a, c, g, or t
  misc_feature (10)..(10): n is a, c, g, or t
gggnggagangagcaggtccgcgacgctgctgctgtgcctgctgggctgccacgtctggaaggcggtgacaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatatggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaaaaaaat

SEQ ID NO: 92404 - DNA, 3528 bp, Homo sapiens
  misc_feature (4)..(4): n is a, c, g, or t
  misc_feature (10)..(10): n is a, c, g, or t
gggnggagangagcaggtccgcgacgctgctgctgtgcctgctgggctgccacgtctggaaggcggtgacaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaaaaaaat

SEQ ID NO: 92405 - DNA, 981 bp, Homo sapiens
  misc_feature (4)..(4): n is a, c, g, or t
  misc_feature (10)..(10): n is a, c, g, or t
  misc_feature (890)..(890): n is a, c, g, or t
  misc_feature (898)..(898): n is a, c, g, or t
  misc_feature (935)..(935): n is a, c, g, or t
gggnggagangagcaggtccgcgacgctgctgctgtgcctgctgggctgccacgtctggaaggcggtgacaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggggccggccaatgtttcccttcccatttcccaaggtncccggttnttaacaacaagggacattttaccaccgtttttcaacnacgggggggttttttttgggcccttttttaagggagggaaaggggg

SEQ ID NO: 92406 - DNA, 451 bp, Homo sapiens
tccactgttaaaagttcatgccatcattttgacatttagcgtcagactttctctttgtaaatccctcttcacgttaccaatgctggtctcagagctcaaactgtttcaaaaccataacatttcttagtgagtgattgatctgtattatgtgtccagccatcagggggatcttgggatgttgcttgtgtaaactgtaatccaatctgatgctgtgcgtttagttacagtctttcatagacctattggcgatactcagtcctcctggatttaggaatagggcttatctgataccttcagggggaaaaaaatccattcatttttctctcttccccacttaaataactcaactcatgtggtaacactgtaggatcattgtccttccagttcctctgcagctcatattgctacaatatttcttaagtatttggttacctgaaggacaatgtgattt

SEQ ID NO: 92407 - DNA, 469 bp, Homo sapiens
ggggccacagtgtatgtgagaatgtgatctcattcaaatgggtcagtcagtagagttaccaatagcaaatgtctttaggtttagatgtgtttatagttacaggaggctatggaaaggtgaatgttaaaaggctaaatgtctaaaacaaaacaaaacccttggagtttcaggtagtgccacgcaatgaatgcagaccccctattgactattgtttattcctttatctctatagttattactcaatttttttttttttttttgagacggagtctctctctgtcgcccaggctggaatgcagtggcacaatctcagctcactgcagcctccacctccctggttgaagcaattcccctgcctcagctactcgagtagctgggattacaggcgtccaccaccacgcccagctaatttttttgtatttttaatagagacggggtttcatcatgttggccagactggtctcaaact

SEQ ID NO: 92408 - DNA, 287 bp, Homo sapiens
ggcccctggctcactctccattgtcacccagcaacatacttgctgtactctggtcatactgctctttgtttggcccctcatattcaaaagactcccatccttatcacatgcttctctttcccctgatcaatgcatcagcccctattcatccttcagacctcatcctaatcattacatttttagtattcagccgtaagactcagagcctcatgtagctctcatagcagcagaactatggcatctgtttgcctcttctattgtcttttttcccttacaccataagctcc

SEQ ID NO: 92409 - DNA, 398 bp, Homo sapiens
gaagccccggtgggaatgtgcacagctcctagagtaccacagaggctggactcaacagagccttccatgacccgctcagctccaccctctgccccttcctgcagctccccagccatccctgcagtgcccccaaagctcctttacatgcaagcaaagcaagcccaagattaaccattagcttttcttttcctaggtttctctacagattaataaaatgtactttatgtacaattcttcccccaccccacccccaagcctggaaaaggcttttgctaacaaaataggaagaaacagattccagccacgcagtcttcagccctggagattcagatcgtgggcagtgccaaagatgctggaggctccgtgaaatctgtttctccctagaagctactgtttcg

SEQ ID NO: 92410 - DNA, 1887 bp, Homo sapiens
gacaaatataaaaaccaagactatcacccttctgtgccctccaatacttttgtagagttggctgttctaacacctaaagagcctagcgacactgctagttttaagccatctcatgagggacctttgtcgcattaggttacaacttgtgccaaaagaactagagggaaaagatgcggcctgagccacacgctactgtaagggccggagaggaaagcaggccttggcctcgcttgttcctgggctgtttttcgtaggatggatttcatttgtcagtcctgcagcgtggcacacttaagggaatggaatgtatcatagggtttcagtttcagtaaacattagcgggcattatctgtaaacagtaactagtttattttgtgttaaattgggaagaacctctttcttctgccacgggtgagatgatactaaaagcaggagaaaataacaaatgagaagagcccttctcttctcagcttctctcaagagtagagactggtgaaaaggggacaggaagaggaatccagctgaagagtggaaagttaacaagaacatcaagaggtacatccctagagagcatctctgggtcactcccaggatgacctcatttttctggaagaggtacatgtgctagctgcatagtaacctatggcacagcaaaagcacaaggaagcgccatttggttttgtttagggacaattattggtagcccaacctatctgaagaattacttttaattaaaaggatggttatttttaggggaccagaaattacttagttgtattcacttatgagttgagcagttagagcagactctgacatctgacacttgagtaaagggatgtttttctcagtactgggtcttttcattagacggatgcatttatatagtgtcagtttttatgcttcactaaatgataaggcctctgtttaaacatgaccattatttacctcacgatttatatttttctcaatgcctgaatacacccaatagcaagcaccaggtggaggttaagacccacaaaaatggaagcaagcttcaagtttataggacatttaaccatactaaccccaatgtcaaaaacaatgtaaattatactcctactgtaaaaggtcaactgatatggcacgtatgtaaaaaacctggcatacaggaaaaaattaatgcatgacagtctaatatattatcctgatacatggattaaattttctttccactaagtattaactatagttttaagcattgattctgcttaataactaaaatgtaaagaccttaccttgtagggttgtaatttctcattaacagaaatctgaacttatacaagtttaactgaaatttatctttatttcaagatatcagaagacatttacatatttgcattttctgtcttgctactatctgcgtatatgtaacagcttttctcaaggcttcaagataggaattgttttatgcctttgtatcacagacctaagagaccaaaattatttgaagatggagtggggacaaaactagggtctctgcagtccctactccatgtaccatccattagctcacctctgtaggtattactaaagtcatgagagttaaatccaacgtgcaactttaatattgcaattccaaaaaataaagctgtatacaactcttggaataactcaccaaaataaatagctttttaatataaaattggttagtgctgcttaacagtctgtgttcatgaagaataaggtgttaataattgtgctcacatttgtttaggagccttccaaagacagtatcacaccttgacgtgttcgacacttgatgtgtttgacaggcgatatgattgcttactcactcacataacccagtgtttggtacctactttcaaacagtaattaatgtgctcagtc

SEQ ID NO: 92411 - DNA, 831 bp, Homo sapiens
  misc_feature (744)..(744): n is a, c, g, or t
gacaaatataaaaaccaagactatcacccttctgtgccctccaatacttttgtagagttggctgttctaacacctaaagagcctagcgacactgctagttttaagccatctcatgagggacctttgtcgcattaggttacaacttgtgccaaaagaactagagggaaaagatgcggcctgagccacacgctactgtaagggccggagaggaaagcaggccttggcctcgcttgttcctgggctgtttttcgtaggatggatttcatttgtcagtcctgcagcgtggcacacttaagggaatggaatgtatcatagggtttcagtttcagtaaacattagcgggcattatctgtaaacagtaactagtttattttgtgttaaattgggaagaacctctttcttctgccacgggtgagatgatactaaaagcaggagaaaataacaaatgagaagagcccttctcttctcagcttctctcaagagtagagactggtgaaaaggggacaggaagaggaatccagctgaagagtggaaagttaacaagaacatcaagaggtacatccctagagagcatctctgggtcactcccaggatgacctcatttttctggaagaggtacatgtgctagctgcatagtaacctatggcacagcaaaagcacaaggaagcgccatttggttttgtttagggacaattattggtagcccaacctatctgaagaattacttttaatagcagtagagcnactctgacattgcactgagtaaaggatgttttctcgtactgggcttttataaaccgtggcctatatgggcagctttatgcttataac

SEQ ID NO: 92412 - DNA, 376 bp, Homo sapiens
tgcaacacacagatgcaacatggtcatctaggattagggaatgatttaggaatacagggacattttctgattttgaaacagcccaatttccaacctctgcatcagatctatccacaggtgggctgtgcgtggtggttcatgcctgtaatcccagcactttgggaggccgaggtgggaggatcacttgaggtcaggagttcaagaccagcctgggcaacatgaaaccctgtttttaccaaaaatacaaaaattagccaggcgtggtggtatacgcctataatcccagctactcaggaggctgaggcaggagaattgcttgaacccaggagatgaagattgcagtgagctatgatcccaccactgcactccagcttag

SEQ ID NO: 92413 - DNA, 226 bp, Homo sapiens
tgaggggggtagattggctaaaaggcccgtctgggctggggagggggctgcttgggcaggagggtggcaggctttagcagcaggcagcaggagaggcccaggagagtgacggagggagggaggaactgctctggaaatcccctaggccagggcctgctctctgggtcacattcttgcagccacctccctctctcccccagtatcccctcctcccacttcctcttcc

SEQ ID NO: 92414 - DNA, 238 bp, Homo sapiens
tacccgcctgggtcacagtgcctagtacttgggattcacaacggtaccgttaaccactgagctgtgctgcctgggccaagctcaggaatcattcatttctttgagttcttttattttcttagtcttaagagctgttcttcttggatggacagagtattagctgttaacatgggagaaaactacttgaaaaccagtttttcccttcatagaaagaaaatcattgttaatgttcagagca

SEQ ID NO: 92415 - DNA, 988 bp, Homo sapiens
tcatctgttttgatcactgaaaagttgtctaaaaactgtgctcattatacacagtttatagtattttaatactttgtttatagtatttaatagcttctgaaaactttaagagaacatactaaaccaaggaactatttattaatggtaatctatatttagtaataaatatatttgtaacttactaaatgtaagtttactaaatgtagattactaaatcactgagtaaatatttcttgaatatttggacaagagatggggggagggagaatgacttgaccctcaagaaacttaactgctacctttaaaaggttataatgaagctgggcacagtggtacacacctgtagtcccagctactcaggaggctgaggcaggaggaccccttgagccgaggagttcgaggctctgtctcttaaaacaaaaaaagttataaaaatattcagactggagggttcctaacttttaatacttaagcagggtctttaccacagagttaaatttaaaattctgtttagaatggtaacaaatttaattatgtacaaaacagcatcactttagtgttaggatcagtgttactcaaagtgttgtaatgttaataacaagcatttaaatcacattgtttgaaaactgggatctacaaaaaatatgattccaataattaactttttaattatgggaaaggcaagggaatgttcagtgaatgtaaaaaaaatatactactgagcaaacaaattgttttaatgaattttgattttctgttttaattttttggtacattgactcttcttgacatggcactttgctattaattaaaaaaaattaaaccccaaagacaaattaattctgtatttaatgcagatttaattcttgactagctgtaatgcttaaggagttggcagtcttgttggcaaaacaataaaataggaattaagctgaaatgtaaaattgtgtaataattaggtttcattaaagtatatatagtttcctta

SEQ ID NO: 92416 - DNA, 434 bp, Homo sapiens
tctaacatgtatagagtgcctgttgccatagtaatcactgatttagcacaacgtgttttttcctccttctttaaaaaaaaattagttcccattcctgccaaaaaggaacatattaatctacccatcatgctagcttggggaagttgaaggccacagaagttgtcatttgtgcaaagactcccagaaagtcagttgttagcatcttctgtgccaagaactctaccccaatcccagagaggaaatgagacactgaagtaaaagattctggagctgaggaggtaacatctctcttcttttctgcaaagtcccacaaaagatgtgcacaaatgctcatgtctgtgtaaacaaattcacctactgattatagatttaacagaccactgatgtccagaaaacagggactaactagacagtgctctttaagacaaaagttt

SEQ ID NO: 92417 - DNA, 370 bp, Homo sapiens
tttcttttttcagagttttgctagaccaagaatgataaggaaaactgcttcttctttctctgtaaagttttagttatgaaaaaggatttgtgaggttgggcttaagctttagccaatctggtgtgctttgcatgtctttctgtatggtcagtagcaaactttgctgcaggcctccatcttgttttacgtccttggaagtgtgacctgtaaccatgtggcaatgctttgtttagcctccgccattttacaatggtggcccaggctcaatcctagctcaggcagagtcctttctggtttgatatctatgtgacttttgctatttgtttattctcttcctccccaccaactgccttgggttttcctttctctg

SEQ ID NO: 92418 - DNA, 387 bp, Homo sapiens
  misc_feature (8)..(8): n is a, c, g, or t
tgtgtttntggattgctaccaaccttagccaagcgtggactagtggtgttgatctgatgccactactgatcagcacgggggttttgacctgctccgtttcctgacctgggccggttcacccctctttagccaatctggtgtgctttgcatgtctttctgtatggtcagtagcaaactttgctgcaggcctccatcttgttttacgtccttggaagtgtgacctgtaaccatgtggcaatgctttgtttagcctccgccattttacaatggtggcccaggctcaatcctagctcaggcagagtcctttctggtttgatatctatgtgacttttgctatttgtttattctcttcctccccaccaactgccttgggttttcctttctctg

SEQ ID NO: 92419 - DNA, 1723 bp, Homo sapiens
tgctacccgcgcccgggcttctggggtgttccccaaccacggcccagccctgccacaccccccgcccccggcctccgcagctcggcatgggcgcgggggtgctcgtcctgggcgcctccgagcccggtaacctgtcgtcggccgcaccgctccccgacggcgcggccaccgcggcgcggctgctggtgcccgcgtcgccgcccgcctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccgctgggagtacggctccttcttctgcgagctgtggacctcagtggacgtgctgtgcgtgacggccagcatcgagaccctgtgtgtcattgccctggaccgctacctcgccatcacctcgcccttccgctaccagagcctgctgacgcgcgcgcgggcgcggggcctcgtgtgcaccgtgtgggccatctcggccctggtgtccttcctgcccatcctcatgcactggtggcgggcggagagcgacgaggcgcgccgctgctacaacgaccccaagtgctgcgacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctacgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagccgtgccgccccggcttcgcctcggaatccaaggtgtagggcccggcgcggggcgcggactccgggcacggcttcccaggggaacgaggagatctgtgtttacttaagaccgatagcaggtgaactcgaagcccacaatcctcgtctgaatcatccgaggcaaagagaaaagccacggaccgttgcacaaaaaggaaagtttgggaagggatgggagagtggcttgctgatgttccttgttg

SEQ ID NO: 92420 - DNA, 682 bp, Homo sapiens
ctgtatgtgtttttaaaatcacaatgagaaattaaaaaataaaatgaaaataagaaatgcttagcatataagaaagtgaagcatcgaagcccacgaagatacagcgagtttgcttactcccagcttgtctggcactgtccagatcttactgccgatagccctgcaccctgagtataacctcagtcccaggcacaccaggtgttcggatattctatatgaaaaccagagcatttaaagaaatggtgtaaacagaataaaggtattttgttgaaagtaaagtataatgctatccttacttggtaatcccattgcctttaaagtgaagcatattactgggatgtaaacctgtatttttctctcttggctctttaacagattctccagatctgtcttatttatatttccttcaaaatacttctgtgatttctatcttttcttgtttccaagccacacttcagcttcattccttatgcacaggagagcctgttcttggtttcttttcttccaggttctgatttttaatctgcccaaattgtaactgggacatttattgacaaaaagaaatttgaacatgtaacagccttttttttccttctaatttttaagtggtttctaattaggtaatttcctgaaggttaaagttcttaaagtctctgatttattagttcatcattcttaattt

SEQ ID NO: 92421 - DNA, 628 bp, Homo sapiens
ggcaacatggtgaaacctgtctctactaaaatacaaagcaaaaggaaggggccggagcttacaaaagatttgcactggttatagtggaagcttttaagcatgtttcaagtgaaactgatgagagttgtaagaagcacagaagcacattggaagagtgttgtctatttgggaagaaaggtctgtttatgcaaatgatgtatttagaggccaggcgtggtggctcacgcctataatctaagcactttgggaggccaaagtgggaggatcactcaagctcagaaatttgagaccagccggggcaacatagctagactccatctctaaaaaaaaaaaaaatcagctgggcatggtggtgtgctccagtggtcccagctactcgggaggctgaggtgggaggatcacttccacccaggaggttgaggctttagtgagccatgatcgcaccactgtactccagcctgggcgacagagcaagaccctgtctcaaaaaaaccacaaacaagcaaacaaacaagaaacaatgaaacaatgtattagagcaacttaagctctgtgtggtgataagaagcctaggaagcaaatttataaacagataaagatgaatgaaaataaaaactgttcttctctg

SEQ ID NO: 92422 - DNA, 396 bp, Homo sapiens
gagaattctcatagttatactaaacctgaggaaaaataacataatattgactgtttaaagagaactctgttttcaagcctgtaaaactaattgatataattttctacctagaatttagatattatgaaatttttttttgttattgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctg

SEQ ID NO: 92423 - DNA, 389 bp, Homo sapiens
cctcgattctacctcagctcacgtttgttgctggcccactgtatgccatcacacaggtctcattttaaccctcacaccaccccacagatggggtcatccctcccattgtacagataagaaattgaggctgagagatgcccaaggccatgcatctaggaagtgcaacaccatgttttaagcctcagtttctccactttcagtccagagttcttcctgcaatgtatgcccatggccctgagccctgtactctgtgccggatggagcctgtaatggttggttatttcatgtctttgttgattgaggcacaaggaaagtcatgtgctttggagttggataggcctgggtgggaatcctggctttaccactgaacagctagagacgtgggcatg

SEQ ID NO: 92424 - DNA, 533 bp, Homo sapiens
gctacagttaacctctgggaggcagataccagaaaagctccatttcgcagcaaggtttctgcagatacagaacttatcttgcctgtctgccagtgtgggtcatggaaaaacttacggctgaacagactggggattaaacccccattctggcccaaagttgatgtttgagatttcaactcttaaggatggatcagtgatgtcatctacaaaatggggatgagcacttgggtaccacagtgagggctaccctaccccagaccttggggaataaaacgaatatggacacttcaaagacaagtgtggagaagccaaattaaagaaacagaatgagtcttcagccaggaagattcaaggattgcttgactgggtatctccagcatgtattaaaagttgtagttggccgggcgtggtggctcacgcctgtaatcccagcactttgggaggccgaggcgggcagatcacgaggtcaggagatcaagaccatcctggctaacatggtgaaaccccgtctctactaaaaatacaaaaaattt

SEQ ID NO: 92425 - DNA, 536 bp, Homo sapiens
ttctatgatgcatataagtaataattacattttttcatgtccctgaaagtaatacccaaggtgctgtccatttcgtgcttcgtgcctaaaaatgcctttcttttccatcagaaagcttatcagaagtataaatgagagtactcttcaagccaaatgcggtggctcatgcccataatcccaacactttgggaggccaaggtggaaggatcatgatcactcgagtccaggagtttgagaccagcctaggcaatatggtgagaccccattgctacaaaaaatacaaaaattagccggcataatggtgtgcacctgtggttccagcgactctggaggccaaggtggcaagatctctcgaacccgggaggctgaggctgcactgagctgtgattgcactactgcactctagcctaggcaacagagtgagaccctgtctcaaatacaataaagagagttctcttctggaaacttagaactgttttaatttagaaaacaaattattcatagttttaaataaataaatttaatgttaatcagta

SEQ ID NO: 92426 - DNA, 324 bp, Homo sapiens
aaagtctgaaaaagcacaaatagacaatataaggtcacacctcaagaagttcgagaatcgagaacaaaccaaacccaaacccagcagaagaaaagaaataaccaagattagagaagaacaaaataaaattgaaacaaaaactacaaaagataaatgaaacaaaagctggttccttgaaaagaaaaataaaattgatagaccattagcatgattaaccaagaagagagaagatccaaataatctgaattagaaatgaaatgggagatattacaaccaataccatagaaatataaaagattgttcaaggctactataaatagcttt

SEQ ID NO: 92427 - DNA, 1357 bp, Homo sapiens
gtggctgagctctcccggtgacagaaacccctgccttgtcgtttctgtaacacaccaccatctagctgtgtcgcaggccctgccctaagcctcagctctcgtggactagtcagagatgagaccgcggctcacagtgctgtctgccgtgatttctgttgtccccgagctttgctgctgtgaggagacccagcccaggccacctactcctcgcagtcctgcagccctctgaaactccctccctgtgccctgcccctcctggtcgctaaacccaagccatgtgttttccgtccttatcttacacttatcttaccgttcttatcttacagcccttaacgctgttgtatgctttttctggaatgttctctggccccggctgcttgacctgtgctctgtttgtcttctgcctcaccagctctttgcacccctcttctgcccatcaattaaacatcagtgttcttgggagtcaccctgggtccatccttcctgcctgtgctgggccatctcatccactcccatggcttgaaatacactgatgggctttgctgagcacctccatgccgaaaacccccaaatccgtattccagatcagatactaacagtagttattgcctagagactgtccaaaggactttgcattgattttttcacttaattctcacagcagacccatgaggtgggcccccactttaaaaaatgaggaaactggccgggcacggtggcttgtgcctgtaatcccagcactttgggagatggaggcaggaggattacttgaggccacaagttcaggaccagcctgcgcaacatagcaagatccccatctctacaaaaaaaataaacaattagccagggcatagtggcatatgcccattgtcccatctactctggaggctgaggcgggaggatcgaagttcacagaacccccataacccatccagctagccaggtagaaggcctccaggtccgacgttgcattccccagggtctgatgctgtctgcaatcttcatccctagcagaagagctaaaatgccattgtgctggggaacaaaaactgagtaacacttttaggatgttaaaatttcaagtgtttacatttttttttttttaactcttagctcattgctcactccagcttttgctagtctccaatttctttccttagattaaatcaatcaagagccagcccctaatttaaaaggtttcctctccttttgtcatgtcttttaaataattttttggccaggcgcaggggctcatgcctgtaatcccagcactttgggaggccgaggcgggcagatcacctgagatcaagagttcaagactagcctggccaacataatgaaaccccgtctctactaa

SEQ ID NO: 92428 - DNA, 547 bp, Homo sapiens
cagcagagaggcccccgaggctgcagggggcagtgggaagaggagcagaataggacaggaccaggcattgagagcatagggaccagatcgcactgggctttgtcagccctcacagggacttggttggaagtcactgagagattttaggcagaggacagaggtgatctgaacttctgtgttaataggctgacagctggtcagaatagacggaagtgagggtgggagaggaacaaaggcggggaagccagttagaaggtcattgcaatatcaggtgaaggtgactccgacggggcagcatcagtggagtgtatgaagcagtcagattctgaaagcagggtcgagagatgtgtagatggatcagatgtgggctgtgagaggagagagggggcatggatgacttcagagtttttgtcctgcacagtagaagaatggagtcctagtttcctagatctggaacattgcagggggggaagatgctggagagaagatcaggagcttggatttgggtgggttaaatcaaagatacttacacaagtccaggcagaga

SEQ ID NO: 92429 - DNA, 646 bp, Homo sapiens
atggaaggaggggtggattccaaagaggcaggagcaggcctcagggagtgtggaacgtgcttattattttcactgccgtgacggttccacgggaatacacatacgtcaaaactcatcagattgtacacttgaaacgttgtttattgtatgtcaattagggtttttcagaactgttaaaaaataataatggtgttggctcttgtaataggcagaactttgagggcaaaggacatgggatgggaatgtcttagacaaatgggaaacacccaaagaccagcggacgggcaacagggagggaagatggaagcctgagaagccaggggccccacaagatcttgtgtgtcttgagtgactgctaagaccacctctgtccactcctacgtagctgaggacgagtgagaccaggctcctcagctactttggtgaacaggcacagagaggcagccctcggagacagcccgtggacaagcggctgtaactgccactgccaccctgaccccagtggggcgaaggagcctcaaggccctgtgtgggctgtgccaaacagccacaagcactttttggagttctgagatgctagagttggtgtgtcgagtgtcaggttcgccgtgtaccctgcagatggtctctcctcatctgacaaggc

SEQ ID NO: 92430 - DNA, 1360 bp, Homo sapiens
cgcggccgccgcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgagctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctgagatgcaatcagattaagcgtagcaagcattgccaatgggaaagtcaaaataatttattttttttccctttccccctaccccatccccagccaagaatttcttttcaagatatcgtcatcattcttaaacaacattcttaacccccagctggggtccccattttaatagatgtcattgcttcaagtctaacggcgccgggaggcctgtttgagggaaaacattagtttgaaaaatccccgttcccttcatccactgcccttgttctccacgtgggagtgtgcttgtggcccctcagaaagatagtctgctggctcctaggggttggggtgggggacacacctttttctcaggaagaggtgatggcaatgtaaaacatctaagcaaagttttaaatgaaaaaaaggaaacacatttaaacatcctgataatggagggaaggggggcacatttacacatagcccagaacttgtagaattctgcatagtgaatgtatattgaattagtctcctgccttatacattcaggaggaataaatttccataatgtaaggcaaatgcatggggttctgaggttcactttgcaagtgcccttgctgcctttcctctgtgtctattatggctctttaagttgacggttcctggagcagcttgtatttagtttcgtttggcagtctggccctgttgactttgatttgcagaccaattctcccttgacctgactcacagccgcctgctcttacccccctcctcaggaagtcttcctcattaaaggatgtgatgacggagctcagggatgagaat

SEQ ID NO: 92431 - DNA, 1107 bp, Homo sapiens
cgcggccgccgcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgagctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctgagatgcaatcagattaagcgtagcaagcattgccaatgggaaagtcaaaataatttattttttttccctttccccctaccccatccccagccaagaatttcttttcaagatatcgtcatcattcttaaacaacattcttaacccccagctggggtccccattttaatagatgtcattgcttcaagtctaacggcgccgggaggcctgtttgagggaaaacattagtttgaaaaatccccgttcccttcatccactgcccttgttctccacgtgggagtgtgcttgtggcccctcagaaagatagtctgctggctcctaggggttggggtgggggacacacctttttctcaggaagaggtgatggcaatgtaaaacatctaagcaaagttttaaatgaaaaaaaggaaacacatttaaacatcctgataatggagggaaggggggcacatttacacatagcccagaacttgtagaattctgcatagtgaatgtatattgaattagtctcctgccttatacattcaggaggaataaatttccataatgta

SEQ ID NO: 92432 - DNA, 1378 bp, Homo sapiens
cgcggccgccgcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgaggtgcggtcttagcggctgctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctgagatgcaatcagattaagcgtagcaagcattgccaatgggaaagtcaaaataatttattttttttccctttccccctaccccatccccagccaagaatttcttttcaagatatcgtcatcattcttaaacaacattcttaacccccagctggggtccccattttaatagatgtcattgcttcaagtctaacggcgccgggaggcctgtttgagggaaaacattagtttgaaaaatccccgttcccttcatccactgcccttgttctccacgtgggagtgtgcttgtggcccctcagaaagatagtctgctggctcctaggggttggggtgggggacacacctttttctcaggaagaggtgatggcaatgtaaaacatctaagcaaagttttaaatgaaaaaaaggaaacacatttaaacatcctgataatggagggaaggggggcacatttacacatagcccagaacttgtagaattctgcatagtgaatgtatattgaattagtctcctgccttatacattcaggaggaataaatttccataatgtaaggcaaatgcatggggttctgaggttcactttgcaagtgcccttgctgcctttcctctgtgtctattatggctctttaagttgacggttcctggagcagcttgtatttagtttcgtttggcagtctggccctgttgactttgatttgcagaccaattctcccttgacctgactcacagccgcctgctcttacccccctcctcaggaagtcttcctcattaaaggatgtgatgacggagctcagggatgagaat

SEQ ID NO: 92433 - DNA, 357 bp, Homo sapiens
cggccgccgcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgaggtgcggtcttagcggctggtgcgttcgagggtcggtcatggcgtgtggggggctg

SEQ ID NO: 92434 - DNA, 273 bp, Homo sapiens
gcacattttcattttgcgctaagccctgcaaattctgtagccagtcctaggcctaagaggccagggatcagggatggtgcagctctctgtcttcccgccttctccctcttcaggaatggctctcccaccccacagacactgggacatcagccttgacgcttcctttttccctcaccacgttcccttcatcccaccttcctaacatagctgagattagcttcctcacatcccctcaccattgctgtgtttgcggcctccatcatctcttgcctc

SEQ ID NO: 92435 - DNA, 521 bp, Homo sapiens
cagtctataaacaaacaagatttgactatatattacctataagaaatctactttaaatatagagaatcagaaaagtaaagagatggagaaaggcataccatgataacaacaatcaaaagaaagctgtagtatctacattaatttcaggaaaagcagacttcagaacaagaaatattgtcattgctaaagagcaacattacatactgataaaagcacaaggagtgaatgtatacaaatcagaaaatattaggagtgcaggaaatcacaggatgaaatgcagaacgtgccaaaaaattgaaccatattacaaatacatgaaacaacttctctgaagcttcagggatgggggttactgacctaaattactttggaagtttagtggagtctttaaaactcaacaaaatgtactgcacagaaacattgtactttatttgatagaactgtttttcacatgggttgatgttgacaattgtaaaaccactctaacatgtattctggaaataaatatgtaaatggactgt

SEQ ID NO: 92436 - DNA, 401 bp, Homo sapiens
aaattaattgtaaattgcattttcactacagctggaaaaataagaaaattttgcacagagccaagataaaaatagatgtcagaaataaatcattagtcttatatagcatttgtttcaaaaaaaaaattttttttttttgagacaaagtctcgctctctcacccaggctggaatgcattggtgtgatctcggggcattgcaacctctgcctcctgggttcaagtgattctcctgcctcagcctcctgagtagctgggatcacaggcacgtgccaccacacctggctaatttttgtatttttagtagagatggggtttcacgatattggccaagctggtctcgaactcctggccttgttatccacaagccttggcctcccaaagtgctgggattacaggcgtg

SEQ ID NO: 92437 - DNA, 402 bp, Homo sapiens
aactagcagtctctgagaactcttaaaggcctgaagatgcctgttaaaaatggacagatctaagatgcaatacagaggagatgctgggagattataaggatggagagtagatgagaccagttgtggttgctgggagtcttcattagtagtggtaagagctgattcaatgacagccaggcagaaagggaaggggaactgttttgtaggtttggggataggaaagaggggggtcaagtatagtcataagcagctgcctgcacatcagtagtggagcccaggagagcacaggccttgcaggtcctttggtgtgtggtacataaacgtgtggtaaatagagggattaatctgcagaaaactccctgcatctcagtagctctcaagtatgtccaggcccacttcttt

SEQ ID NO: 92438 - DNA, 224 bp, Homo sapiens
aaacattacaaattagtgattaattgcatttaaagcctagttaagactatttaagactattatgcataatacaggaaaactacctgtattatttatagtgggtgccttctgaaggatctgaaggagaatcagttctatgcctctctcctcattcccaggaggtgcctggcattccttggcttgtagacgcatcaccctaatctctacctctgccttcacatggt

SEQ ID NO: 92439 - DNA, 316 bp, Homo sapiens
gcgtgtatctcacacattgttccatgttcaatgtgcctaatacaaaacaagaatctacctacaaggggtttaccatcttgctgaggatgtaagacttgtgcacaaatacccgccatccaaagcagctcaagaggctatgctagtgttaataataataaataatagtagccatgtccctgaggaatgccaacccatctattctactgctggaggcaatacggagcctctgcagggctcagtgtccacatctgtgaaatggggttgtaggaacactgactaagataaggaatagagtaactactggcaggtaaaggca

SEQ ID NO: 92440 - DNA, 778 bp, Homo sapiens
agatgtcagttctgtttcattaacaggatactcagtcacattggcagaaaatcctgtggctactgtttgagaatgagtgatcattatttttagaattattgtgtattagaccagaaagtaactcaaaagacccaccagttttgccattagttatagatactgagaccattcattcattcattcattcattcaataatatctatgctctataaagcctgtgctggtctcaactagtcaaagacactgaccctaaatcacccagcaaatcagtgataaagctgtgattccaagccaagaactttggcagatcactgtaatcaatacacctagtaaaacaccaacttacactgtgacttcattaaaataatgtactatttataaattgtaagaatttatgaaaaacagaaacagtgtaagcagcgctggacatctagaatgcctcactgttttatgatctaaggcacatcagattgtttttcccaattatcatggagctagttccctacacttcacctcagtgctcttttgtcaaccaagataaacccctgatggcgaagcaggggcaggatagacagagtccccaggtggagtactagaactaacacttaccattatgtgtgacctctgacaggtcacttcacctgcaggcacagctagagcaagcagtgacgcatgcgcaggggtgtcccttgcctccaatgcagccaccatcccagctgtggtgctgaggatcacactagccccaactaagacctgcggctggactcctgcctctgct

SEQ ID NO: 92441 - DNA, 308 bp, Homo sapiens
gcctgaatgaagtttctctaatactcatattttttttgtaacgcacatcacagtcttcttgcactcaggaccactaggcagcgttttagcactaggggcttgttttaaacagtgaaaccacaaacaaaaagcacagaagcatgaaaaacatggcgccaaatagaagaccatgggagggatgcttgttcacagtgtgagagctgaaatgaggaggcagagcgttgccatgtttgaactcaggtgggaatgtgcatatcaggtggcttgaatttttttctgctctgtgagtgtctgaatgacagagtgcc

SEQ ID NO: 92442 - DNA, 148 bp, Homo sapiens
catctgtttctctttcattttctctatgtcaaatattccctgtgtcaggtcgggtgcgttggctcatgcctgtaatcccagcactttgggagtctaaggaggaaggattgctcgagctcaggagttcaagaccagcctgggcaacatt

SEQ ID NO: 92443 - DNA, 436 bp, Homo sapiens
ccctgagcatctatcctgtgtgatagtttcaactttgctgagatgtaattcttatgtaaacagaagacaagcgcttggaggcaggtgagtgagccccttctaacagtccagcaatctgcctttcagtgaggctttagagttcgccacctgcctccatgcatccgtgtggggaaggggagctacaggatcaggctgtttatgcatctggggacccctcaatggccagtggcatgtgccaacggcattctgcaagtgtccactggaccaggtatactgcggaactcagacacccggtctgaactacttttttaaattgtaaggtctggagctgttcaacattgggctcaagatcaactcatgttagagccttttctcatcatctcacacaaatcttattacatattaaacagacttcccaggtaataacctacattct

SEQ ID NO: 92444 - DNA, 600 bp, Homo sapiens
gctcagaaagatttgacttttttaaatgatgcattcttatgtcaatagactttaatctgcaaccaaaatgttttttttttaaataaaaatgaggcacatttgtgctttctcacttctgctccaattctaccttattctgcaagttgctattttttcctttagcagtacactatagatttaaaaattgtatggtattttctaatataaccatatcaatttatcagttttcctattgttggacatctaattcactcatatttgtgtcttcttcctttcccttacagagtttttgtaaagaaggctgagtgttttcaaaagttatgtttatatttacatgtgtgtgaactaccattttctgtatacccttgctgataactattaagaatcttggtctggcatggtggctcacgcctgtgatcccagcacttagggaggctgaggcggtggatcacccgaggtcaggctggcctcgaacttctgatctcaaatgatccacctgccttggcctcccaaagtgttggcgtgagccactgagcccagccagtaatggtatttaatgtataattattgtagctctttctccagtttgttatttgtaag

SEQ ID NO: 92445 - DNA, 439 bp, Homo sapiens
ctagaccctttggcccagggaaagggttaacctcctggacttttaactgagtgttttacatcttagcttttagattcttgtgccagagtagtttcacttccggtcattccttctggctgctggcctggattcccaggctctgttttctccttgtggaggccccggcagcacccgatccaagggccgcacacatctggatttggcttccacacgctgtactaactattcttgcccttttggcccctgaatcccctcatcctttgctttttccacctgagtaggtgtggcctcctggtctgcaatggatttcattgctgcgtgaatttcccctgctagtgacttatcattgagggccccattgcaggactctaagcggcaccgtgtaagacaccttagggacgacctttggccaccccaggactttgctgaaaatgccaaa

SEQ ID NO: 92446 - DNA, 2483 bp, Homo sapiens
gaattcggcacgagggcagtgggggttacagacagcaccagaggcactcagggcaggagggtagtgggtgctggtcaaggccgctttgcaggggattgggagtggatgctagtggcagtaaagggtaaagggagggcagtgggctctgagctaggaggaggtggcccagccacttctgcagagttcctaaccccagacagctctactgcaccaccccagcccttccccacagcccaaaggaacttaagagggagagcactgtgggcatgcagccaggatttccagcattgcttccaggctcctaggggaaacttaggcactagcgcagactacatccagacatggctatagggaaaagtttgccttgtggcacactgggtatgcctctctatcctctctcctcccccagcaggcatgaagacccccaacgcacaggaagccgaaggggcaacaaaccagggcagctgcaggacgggccactgggtctgcaaacatgacaaagaaaaaagtctcccaaaagaagcagagaggcagaccttcatcccaaccctgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacacatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaaaccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtactgaaagcttatggaatccctgataactaaacatctttgccagcattaactgttgttttgctctaaaaaatacaaatttgtgaatacatgacatgctgtctgtaagccctttgtcttgttgaaaagttcgggtgtgtttggtagatggggcatggaaggaacgaacagctgtcaatttcggctgtgaataaagttcagctagaatcataatcagtcatttaaaaatggcactggatttagctggtctggtctggagggggcaggggaaggaacaagagattggctgtcttggggagagaggaggaggtgactgcttaggaagaggtggaaaagggccagaaagggaggggctccttgggggaggggatgacctatgagaaggaaacatccaactcagaaggaagactaacagagggagagtgagatcttggggcttagaggaaaatagaataaactgagtagagaggaacacaaagaagcttagaagagggtccagagtaaggtggagaaggatcaacctgacagggatctgggagaggctaaaggatacacaaaggaagaggctatgtgggttagggtgttggagggattagaagagggccactgaggaaggaggaattcaaagaagaaagactgacagagggagtgagaatacaggaaaagagttgtggggtatggggcccatgagagatcggaaggcccaggaaaatgttggacttctggtagtgtccacattgctcttcctggctctatgcacaaaggaagtggcaactgtcaaagatgccagatgcattggaggttcactagaagagcatgttgacaggaatgactcagtcaagttaatcaggagccaagtttatgcccataaggcttttcctgtttcagggagttaatgacacacttgtccagcagaaacccaatgctcagcctaaacacgctaacatggtgccccacatgtgctgggctgtgggctgcctcctcacatttgtcctgcgctagataagcaatcttggtagaggatgggttagtggggctctcagaacttaagagatgtgccatcttgcatttggaaagtactttatccagaaaaaatgaaatcttactgaactcaggtacagcagtctcatcactcctattccttctgctggaatgtttgttttctatctagagatgaggggcatcagaggactgagcctagtgtttctctcgag

SEQ ID NO: 92447 - DNA, 732 bp, Homo sapiens
tctcacattgcaaaatacagtcatgccttcccaatggtcctctaaagtcttaactcgttccagcattaactcaaaagtcccaaagaccaaagtctgatctgaaactcaagccaagttccttctacctatgagcctgtgaaataaaaaatcagttatttacttctaagagagaatggtgctacaggcataaggtaaacattcccattccaaaaggaagaaattggccagaacaaagtggcaataggccccatgcaagtctgaaacccagcagaacagtcattacatcttaaagctccagaataatatttgactccatgccccacatccaggacacactgtgcaaggggtaggctcgcaaggcccatcctagtggttttgcaaggtgcagcctctgtggctactctcgcaggttggagctgactgcctgtggatttccaggctcagggtgtatgctgccaatggatctaccattctgaggtctggacagtggtggcccctttcctacagctccactaggcagtgctccaaccccacatttctcctctgtagtgcctaagcagaggtttcctgcagggactgtgccccgtggcaggcttctgcctgggctcccagagtttccaatacatcctctgaaatctagggggaatctttcaagtctccttgactcttgcattctgttcacctgcaagcttaacacgatgtggaagccaccaaggcttatagctttcgccc

SEQ ID NO: 92448 - DNA, 157 bp, Homo sapiens
gtacaggggagagttgagctgtgacaaagtcacaacacaggccttggccacccacaggagctctgcagctggggtggtcttgaaagttgtctcagtgaaggcaaggtgctgagcttattaccccagcagtcattgtatttaggctccgtgtggtacc

SEQ ID NO: 92449 - DNA, 294 bp, Homo sapiens
gccatgggaaatggctgtgtgaagtcacagaaagggacaatgtgaagtcacaggaagaagcagagtgaagtcacaggaaggagcagtgtgaaacaataggaaggggctggaagatgtcataagaagaaattatgtgaagtcacaggaaggggctgtgtggagccagagaaaggggctacgtgacatcacaggaaggaactgtgtgaagccaagggaaggggctgtgtgaagtcacaggaggaggctgtgtgaagccacagggtcagtatgaagccacaggaagaggcagtgtga

SEQ ID NO: 92450 - DNA, 547 bp, Homo sapiens
actgatttatcacagcaaatcatgtgggtgagaggaacggaaacaggctgacttcttagttcaccttcctccttctcctttgtctgcgtgatcagagctcgcctggcctccagctggcacggattttgttttgtgtgtccaagggacgagacaagaggaacgtgcccatggaagcttttagcagatgtctcttttttgaactacatacttcatactggggtaatttatgaagttaatggaatgttacttgtattaagtaacagattggataatattaaactccaggtctaataaataaaatggcatactctctgaaactgctccctgtggtaaacaaaaccagctgttagtagtgtaaaaacagaagatgtgtactttttttccttttttgcaatgaaagaaaatatttaggaatccaattttcttgtcactgcaatagcattgtatttatactctacataatagcattcactttgctgaaaatagagactaaaaagaagtatttttcaaagaataggaggccgtgccaccagctaataatatgtaa

SEQ ID NO: 92451 - DNA, 494 bp, Homo sapiens
ggaccacaggcacgtaccaccatgcctggctatattttttgtatctttagtagagacagggtgtcattgtgttggccagactgatctcaaactcctggcctccagtgatctgcttgcctcagcctcccaaagtgctgggattgcaggtgtgagccaccctgcctagccacatataagaagtttaatttgcattttataatggtgaaagttaacatttttctatatgtgtgttaactgtttctttttgcatgattggtgtatgtgtatcctttgactacttggctagcagaaagtcaccatctttatctgttttgctgctgttcactttctcctgatggcaccagtctatcttctttattagtttctttcgttcctagtattctatggtttagccttttattacagtgttaaactactattggatgaatcttctgctgccacttcttatcagctctcataattctagctttcctcatctgttactataaattggt

SEQ ID NO: 92452 - DNA, 314 bp, Homo sapiens
ctaacaggcatttctctcttcttcttattttcgatctcacccccacccttaccccccacaccaatctctcctcccaactattgccagactgattgtcccctacacagccagaccatttcatgctattccctgccacctgcagaatttattcatttgcaaataccctctacctcgaccatcccaaattgctcacagttctccaaacactcactgttgttctcaactctgtggctctgtacactgttatcactgcccataatgctgtctcttcctcctcacccacctggagaagagctcatccttaagacttggtt

SEQ ID NO: 92453 - DNA, 300 bp, Homo sapiens
aattgccataacagtggtattaaacaagataaatctacaaactaatacctcaactggactctgcctatctcccctggttcacctcatgcttattcaccttcttattcttattgaaatttccagttcaccatttttacatatagcttagaatcttattatcctgtaattgtacatttgctgatctgccactttatcattttattgttgcttccttgtttttattatcagcttagcagtacactatctacaattttaagatatcactttgtactttatcaaagttagacctcagatcctggg

SEQ ID NO: 92454 - DNA, 162 bp, Homo sapiens
acttattaacaaaatcatttagaagacactggaatagtccaagctcttccattcactagctctgtgaacttgagcctcagtttcctaaccctcaaaatgacattgaattatatctccaagctctaaatcacctgttagctctacattgctgacttcatgatt

SEQ ID NO: 92455 - DNA, 294 bp, Homo sapiens
  misc_feature (281)..(281): n is a, c, g, or t
atggatatagagacatacagatagacaggcaggtagacaggtgacagatgatggatggatgcatagacagatgatggatggatggacaggtaggtagacagatacatagatggatgattgaacagacagacaatagatcaacaaatgaatggatagacgggtacacacatggatgatagatagatgcatacacagacataggtagatagatcggtagcagataggcaggcaggcaggcagacagaggaaactctggtggaggtccgtagcggtcctgtcgngctagtcggggga

SEQ ID NO: 92456 - DNA, 155 bp, Homo sapiens
ccttccctctctatccattctcccacacgccttgatggctttcacacagcttccaacccagcacaccatccccactgctacaaccccaggtttgtgcccccacccaattcacatgttgaaatcctaaccctcaggttgacagtattaggaaatga

SEQ ID NO: 92457 - DNA, 885 bp, Homo sapiens
ctgccccaggcccacacattggcattcttccctccctggccagcacctttgtgaccatcaggtcctttgcacacattgataccatttgcttagaatgctttcctttgtggctctttgcatccttgggaaatccaggattaagagtttactaggtgtggtggggtgtctggtagtggtcaggtcctctgctctgaccctctccccaggtcccccaatccagacatttgaaattagcataccctctaattcagatggacagaaatgtattgagagcctactgtgcagcagcagagttgtcaatactagagatacagcagggaatcaacaggggtgtctgtcctcaccaagcttatattctcatgggggaaaaataattaactatataagtgtgtgtctgtatagagaaagaggtaaaagggagtgatagaagctgctaagtgctatgaaggataaagaaataaagcagggagtgggggtaaaagaattagggagaaattggaatttgaaacgagaaagtcaggaaaggcctcattgagaattttacaactctctcccttctgtataagaactttgaaaatcagaaaactccaggtaatttccattcagggctggagtacattgagaggagagggaaatgagatgtcaagagtaggggctgaagtgtgtggatctttgatgtattctgctggcttgtgggttgccttcactggattcctcagcctgtggtgggcatagcctggcatggctcttatagacacaggatgtttggcaaacatattgacagctgaaagcagagctgctgagctgcattatcatgaatccaccgcaagcgtctagcctggagctgcttttcacccaagacaacagcagttggaacctgtgaat

SEQ ID NO: 92458 - DNA, 342 bp, Homo sapiens
ggctccagagccctggtgcccttctcctctgctgagcgtccacccagggttcacctcacccaaggtctcatttcctttgctgtcattccgttctctgctcaggaccttggcactccctgttcattttgatgatcattttgatcacctatttatagacctggcatgaagcaggcaggccaattagtgttcaagtggattgagttgtaataatgtgagtcaagtcctggtgcttgtgtgttaaagagcagtaagagattttctgcaggtgttagtgaatttcaaacttcacttttctcctttgcacagagctcagcacagtaaaaccaatttcaatgcaagagc

SEQ ID NO: 92459 - DNA, 385 bp, Homo sapiens
cgcttagttgctaccatgacctcataagctataattttaaatgattttttgaaatatttctgtattaaggttatggtattctgatttcttaaaagttcctatagccgggtgcggtggctcatgcctgtaatcccagcacttgggaggccaaggcaggcagatcacttgaggtcaggaatttgagaccagcctgaccaacatggagaaaccctgtctctactgaaaaaatacaaaattagccgggcgtggtggcacatccctgtaatcccagctactagggaggctgaggcaggagaatcgcttgaacctgggaggtggaggttgcagtgagccgagatcacaccattgcacttcagcccggggatcaagagtgaacctccgtctt

SEQ ID NO: 92460 - DNA, 480 bp, Homo sapiens
ctcacatcatgtgcttgggtttgttttctgcctgtcccttaaagctttcgaattctcaaacacagaatgaagtccagatttattggcctagcattcgaagacctacacgattggctcttgtgtttccctgacttttttttcatggcaatatcctcacaggtgattgcagttctctaaactgtatgcttttcaggagtataaaaagtaacaaacagtttggccaggcacagtggctcatgcctataatctcagcctcccaaaattcagggattacaggtgtgcaccactgtgcctggccatgtgtctgaatttttaagcaaagggagatgaatcatattccatatgcccatttcaaagctttcccctgtatatcgtgctcatattcccatattgtttaatagcttccttcagcgtgacttttgcaatgtttttaaagactgtgctgtgatacgaaaacatttttatggcacaataataaat

SEQ ID NO: 92461 - DNA, 274 bp, Homo sapiens
caggctggtctcgaattcctgacctcaggtgatccacctgcctcagcctcccaaaattcagggattacaggtgtgcaccactgtgcctggccatgtgtctgaatttttaagcaaagggagatgaatcatattccatatgcccatttcaaagctttcccctgtatatcgtgctcatattcccatattgtttaatagcttccttcagcgtgacttttgcaatgtttttaaagactgtgctgtgatacgaaaacatttttatggcacaataataaat

SEQ ID NO: 92462 - DNA, 441 bp, Homo sapiens
cttggtttgtcaacagcatctcttctttgatttgctgtcatcagattcactgccagataaaggttttctttttgtaccatctttttcttcaccagctttttgagaattaagaaatgcttcaattaactctggacaatctaaattttcttcaggttccaaagtattgtcagcatctgtaaattccttcaggaaatattccactttcccattccctgcgtgtctatctagtacattttccaccacaaattcttcaggctctgcctcttcaacttttttacttttccattctgtttctttcccatgttttgcaatgtggttttgttggaggccattttttattgcagacctgaagagctattattcactgcctccaagctgctctgggtcatgggtctgtggtgtctccagtcttgcatgtcaccagctcgagccacatccaag

SEQ ID NO: 92463 - DNA, 166 bp, Homo sapiens
tgagaccagcctgggcaagatgcaagatcccatctttattaaaaataaataaacaaaatttaaaaagaaaaaagaaaagcagttgctttgttggaaaatatcctctttgctttaaatctgaaatcctccaggccaggagcggtggctcacgcctgtaatcccaaca

SEQ ID NO: 92464 - DNA, 275 bp, Homo sapiens
aggggaaatacgtgtgtgtgtgtgtgtgtgtgtgtatgtatgtatgtctacatatacacacatatacacgcctcgcatagattataatcttaagtcctaaaaacaattcatccagccaggcgtggtgggtcacacctgtaacccagcactttgggaggccaatgctggtgaatcacctgaggtcaggagttcgggaccagcctggccaacatggtgaaaccccgtctctattaaaaatacaaaattagccaggtgtggtggcacatgcctgtaat

SEQ ID NO: 92465 - DNA, 370 bp, Homo sapiens
actggaatatattaaaatctctccaattttattttgctaataggcagggcaaagtctgtccataaatgtatcctgatttatcacaggtaatcccacactttagcattcatgtgttgtacttaacctcaatttaaatgtaaattttgggaaacttcgagtgctttatctgtgaactttgagagctctcttcattaatgaggcctgcactaaattataagcagttttatgaggtttccttaaaacaattgcagaattgaccccaaaatgaacaaatttagaatttatttgttttttttattaggttggtgcaaagaaattatgttttccacatttttaattgcaaaaccacaattaagtttttcatcaacct

SEQ ID NO: 92466 - DNA, 570 bp, Homo sapiens
tgagacggagtctcgctctgtcgcccgggctggagtgcagtggcgcaatctcggctcactgtaagctccgcctcctgggttcacgccattctcctgcctcagcctcctgagtagctgggactacaggtgcccaccaccacgcccggattttgttgtatctttagtagagatggggtttcagcgtgttagccaggatggtctcaatctcctgaccttgtgatctgcccgcctcagactcccaaagtgctgggattacaggcgtgagccactgcgcccggcccagaacttttgatttccctcccacaccatccaattcatacacaagtcctattatttaaacttaactatatcttgaactcaggaaaacttctctccatttccactactacctagttaaactaaagtcactactctttcctgcatcatttcaatagcttcctatttgttttctctgctgctactcttgtcccagtaaaccaaagtagccaaagtaggttttaaaaaatataaatcaggccactcatctgcttaaagtcctctagacacttcccattgcactttcagatcatt

SEQ ID NO: 92467 - DNA, 318 bp, Homo sapiens
cagcctggggccgctgtgatggctgctatatctatcctattaagttgataccctaaaactcagctctactcccccagctgtgctcaaaacaagaaatacagggaccaacaggaccatggtgtggttaagaagctaccagcaatccacatttatctcaacaagcagcgaagatctcaagaatcttctactttggtcacagaaggagctaggcaaccaatcacatttctctcttttctcttgtatccatgcatccaataaatgatattctcctcttttttaagtgtccagttctaaagagtacttaattcaattgagcat

SEQ ID NO: 92468 - DNA, 170 bp, Homo sapiens
taccatctgatataaaaataatgtagaattagaaggggtctttgctgaagacagtgagatcatttcagcaccaagcatgaggtgatggagcctagaccaaaggatgccatccaatgagtgggggtgacagagacaacaaatgtttggaaggtagcacagtggactgggtg

SEQ ID NO: 92469 - DNA, 216 bp, Homo sapiens
gttattccagctcagggtgccaggtgagaaccagccctggacagggcaccatcccattgcagggcgcactcacagtcactcattctggaaccgtttagactcatcaatgaacctagcatgcatagctttgggatgtgggaagagtacgcagaaaaaaaacaggtgtgcatggggagaaggtgtgaaccatatagacagtggcctcagttgggagtt

SEQ ID NO: 92470 - DNA, 360 bp, Homo sapiens
ctcccaggttcaagcgattctcctgcctcagcctccctaagtacctgggattacaggcatgtgccaccatgcccagctaatttttgtatttttagtagagatagagtttcaccatattggttaggctggtctcaaactcctgacctcaagtgatccaaccacctcggcctcccaaagtgctgggattacaggcgtgagccactgcaaccggccgagatcaccaactttaatcgtgaatctgccattttcttctttcacttttgtcagttttaatatcatgtcttttgaagcaagacaagggtttttaatgtcctctggatgtactgatgcctttattatcacaaaatgcccttctttatc

SEQ ID NO: 92471 - DNA, 893 bp, Homo sapiens
ctgtgacagtggtcgcaaatacagaagagataaaatatttcaacttgcaggatgatgtagagaaagtgagagttgtatatgtgaaaaaagccttttaaataccactttgattttaggtcatgtgccaaccaaggatgtagagaaagctgaaagaggacatgctaaggaaagtaagttagcaagtggtatagtgatgccctgggctcataagtcaacaaacagcatgaaatacagagacagttgtgcccatctgatacaaatgtcatgtgatgcagatgactcagtaacagcggaagtgctacaaaaagaaaaaaacttgtaagaacagccctacctctgcatataaaatacttgagtactttcagtttcaaaattaaagattgctcagaaaccacctgccatacagaagatatttaggatgaaaatttttgtcaaatgattgagaatgtgttaggccattcttacattgctgtaaggaaatatctgagactgggtaatttataaagaagaggtttaattggcttatgtttctacagactgtacaggaagcatagcactagcatctgctctgcttctgaggaggcctcagggagcttttactcatggcagaaggtgaagtgggagcaggcacgtcacatggcaaaagcaagagtgagagagagagttggggaaagggaagtaccacacacttttaaatgaccagactcacaagaactcactgtcacgacggcagcaccaagccacaaaggatccattcctacgacccaaacacctcccactaggccccacctccagcattggggattacaattcaacatgagatttgggtggggacaaatatccaaactattagattggtgcaaaagtaattgtgatttaatacgtcagagaat

SEQ ID NO: 92472 - DNA, 397 bp, Homo sapiens
gtgcaaagcaaacattgggttcacatcatgtacaaagtagatagatatttataagttttttttctggattgctgttctatgtcacttatctgtccttaaccttgttttagtagaactcaacctaatcagtactcagggagaactttgacagcagaattattaaatttaaactctagagatttagatttcaaggaattcttaagtcatttttaaaaccactcctttagtgggcacatacaacttggctgtgagaactacctccccttacccaaaccctggttactggagagagactatacttgaatgaaaactcttgtttctagtggtattttgaacagaaaagggaggaggacttaagcaaaatgttaaggtaatagaggcaattataaatcattaa

SEQ ID NO: 92473 - DNA, 460 bp, Homo sapiens
tccagtctatcactgatgggcatttgggttggttccaagtctgcaattgtaaatagtgctgcaataaacatacgtgtacatgtgtctttatagtagaatgatttagaatcctttgggtatatacccagtaatgggagattcctcaaggagctagaaccagaaataccatttgacccatgacttttgccatataaattaacctaatgagaggagtgacatttcctgacctttgccattttccactgattagaagcaagtcaccacctctgctcatactccaggggaggggactaaacaaggctgtggactccaggaggtgggaatcatggggccacctaacatctgcctgtcatacctatcttcatgtcctttcaatttggaagagtaccaataatttattctgtcaaatttccccccgctgggtttgtatgatgtgtttttataactgaaatgaggcatg

SEQ ID NO: 92474 - DNA, 852 bp, Homo sapiens
ttttactggaggagccccgccttgggttctttgaaagcctcacacatctcataggaaatcttgaaaagtattcattcaaaagttacataagaaccatccagtatgtggtagaaaatgaggtgaagatcgggagcatggggttttgttttcttttatttgctgggattattgagagttatattacggaactgaaagagaaatactagtaatctgcctaatttgaaaacaagtgggagtactgattagggcataattgaaactcctgatactcatagttactgttactaatgaggaaaatgtttcaactgatattttgctttttaatatatttacagaaagtggcattataaattcaggtacaaacacacatgaacacacacaaatctacacatagagtggggtgctggaggtggctagcactgtcttgaaagagacatttgtgcatatcttttcccaaatccagttcagtggctttaacttgatagcttgaaatttgccgtaatgggcatatttactctacaaaaatgagcaagggatacaaatcaatgtgtttgcttgtttttcatagagccagtttttaaacattaagcagtacacattgtcataacacgcattcttttctcaagtttccatgactgttgcggactgttcacatttatctgcaatggttttgcagagtcatttaattaagggtttgatttcttaatatctttctttctaatttctgtcccagagggtggcagcatagtgcagtaaaaagtacctgggggctttgtattgaaaggtgttaatccctgttctgtccctttggctctttgaccttgagaaagtcacctaagctttctgacccaa

SEQ ID NO: 92475 - DNA, 522 bp, Homo sapiens
gtgaacaggatgtgcctgaatgctgcaggggcagcaaggtgagccctgggctctgtcctctctgctaatgggagacctgaggaggaagcacccactccagccagaggcaacactcactggcccggggacgcgggcagggccagaaatgcaggtgcacccactgctctcgtgggccccaggttgaactgtctggtgggaaggccggagtttggggtggtgatgcagggggttgtggcccagctgttggggcacggccatgggccaagcctcagtggtgtgaggatcaggagggcgtgcgacaagcctgggactggcctccagatggcgcctgggtggtcccacgcctcggcgacaacaaggacctgcctttgatgaagagcagagggaggtgaagagcacagaagctggcaagccagggagcagtggtggcaggggcacctcccctctccagacactgggccacccagccactgagaggatagcgatcaccccggccacccttcccgaggtggggcgggaaga

SEQ ID NO: 92476 - DNA, 427 bp, Homo sapiens
atggcgtttgtatctgaggactgggccaagattacagagggagtgagcaacgcgtggctttggatatgcatcgaggttgtcagctctgtgtccagcctgcgtgtggtaagcagcaaccactctacaccagttgctgggcacccagcagggactgggacagacaggacaggtgaacagttaaatgagcaagaacattctggggcaggcacaggggctcacacctgtaatcccagcactttgagaggccaaggcgggcagatcacttgaagccaggtgttcgagaccagcctggccagcatggcgagccccatctctaccaaaaatacaaaaattagctgagcatggtggtacttgtctgtcgtcccagctacttagcaggctaaggtgggaggatctcctgagcccaggaattcgaggttgcattgag

SEQ ID NO: 92477 - DNA, 317 bp, Homo sapiens
ccttaatggtggccagagctaccatgcagtgcaaaaataaattaagtgaaaatgtattattgagattaacagtgcaaggccaatacattttataaatctgtcagtatctttttaatggactgtgtatgtgtagttatgttgaaagatacattgtgtatgtgtacatgcttttgtgtgaattcaaggcacactgtaagatgtatttcccttctctaaaatccatgttgaaatgtaagtacagattgatagaaataggtgttttacttaaactcatataatctgtttcagcaccttttttaaaatgtataattgtactg

SEQ ID NO: 92478 - DNA, 395 bp, Homo sapiens
acccgggaggcagaggttgcagtgaactgagatagtgccactgcactccagcctgggcaacagtgagagtccatctgaaaaaaaataaaataaaatgcagaggaagagaagtggagattcccccattccagcagcctccttcccacccacactggagttttggatttgggggtttgatggctctggcatgtctaggccctagaggggttcagaaggaggggtcttggggacacagagagtacttcaacaatcccactttaagacagttccctttgggccgggcacagtggctcacacctgtaatcctagcactttgggaggccgaggcgggcagatcaactgaggtcaggagttcgagaccagcccagccaacatggtgaaaccccgtctctact

SEQ ID NO: 92479 - DNA, 324 bp, Homo sapiens
ttcggaagtgcctgaatcattgacaaaatctgtcctttttttcttgtttttgcttgatgctactatgtctgtccctgacttctgctgaaaagctagttatgcatttcattgatcattccttgtgtggatacctgtattggctttattaacaatgtgtttatggccttcagtttcttccttatgggaaagagggactccaacttctctcaacatttaaatatatggacgttctgctgtattctctctctccttcatggtgaaaaaaaggggtgctgaagggtttgtaggaattcattagttttccagaataaaaattgtttgaaa

SEQ ID NO: 92480 - DNA, 339 bp, Homo sapiens
gcatagggctcggcgtgacgccccgcacccggcccagtgcagtggttcttaatcctgaagacatattagaataatctgagacattaaaaaaaataccaatccctgggcccaccccaaactaaataattcaaatctctgggcatgcagactgggtattggtatatttttaaaacactccctggctgactctaatctccaaaactctaacggaagagaattcggaggcaagtagggggccttgctgcaaaatgtggtctgcacatcaacatcacagggaggcttgatggaaatacaacctctcaggccccataccagacctactggaaagaatctaaaaat

SEQ ID NO: 92481 - DNA, 504 bp, Homo sapiens
cacataattcatcgaaggcagagttgtgcagcacaggatactgtggttggtgtggagacatgcaaagggggagaatgggcctgttttagttaattctgcgaagctacaacagggcaactgacacttccttcagccccaccctggggagggggtcagtacatattgtttggtgatatgagactgggaaacctctcactggtgactaatgcaactggatgccaaagtccagcaggattagattagttcggctcagctggtcccgtcttctaagtatttttttcccatgactcagggctgggagtaggggacaggattctcttcctccgtctgaccttgcaaacatgtcactgaaaaggagcctgatctgacagcatcactaccccagggagccagggaagaagtggggttttggggaagcctcaaagatatcagtaataatagaaagcacttgcatgccaagcaccatattaagcactttttacacatgattttatttaatcctta

SEQ ID NO: 92482 - DNA, 429 bp, Homo sapiens
  misc_feature (11)..(11): n is a, c, g, or t
  misc_feature (52)..(52): n is a, c, g, or t
  misc_feature (55)..(55): n is a, c, g, or t
  misc_feature (122)..(122): n is a, c, g, or t
  misc_feature (154)..(154): n is a, c, g, or t
aaaaaactttnaaggggcaaccctttccccctaccttttccttctttaatcnccnggtttaccattgatgacttcgcctctgcatctactgacttgatttttcattctgccactccatcttnaaaccccctcacctttcccatcctactcctgnccatgcattgaagggtcaatgcattttggggtgagctctgggtttaggggccccctccatccctcagctaccctggatctttgcccacctcttcctcagagcccccactgagggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatgg

SEQ ID NO: 92483 - DNA, 243 bp, Homo sapiens
cggagctcacacggtaatgctctgacgggaggcggagctcacacggtaatgctgtgacgggaggcggagctcacacggtaatgctctggcgggaggcggagctcacacggtaatgctctgccgggaggcggagctcacacggtaatgctctgacgggaggcggagctcacacggtaatgctctgccgggaggcggagctcacacggtaatgctctgccgggaggcggagctcacacggtaatg

SEQ ID NO: 92484 - DNA, 383 bp, Homo sapiens
gtactaatcaggctggaattctaggggcttcccatgtgacctcattacccttagcctcagcaaaaagctcaggactcctacactccctgggatgggcaggcagtgccaccacacagacagacagatactccctaagtatccccaacccagtcctgtacaaggcaagccagtcatatggctttagccacagaaggaaaccaagtaagagaacaatgataaagctacatgactccacgatgactactggaaaaacaactcaacaaactccagcaacagcaggttcgtaatcgctatttggagttggaatttcaacatgtatttatggctctgacatcggatgacaaaataatctactgaacaaagtgaaaactctctcccaccag

SEQ ID NO: 92485 - DNA, 478 bp, Homo sapiens
ctggaaggcaggagctggggaagcctggcctctccgcacagacatccttcatcctggtggggcagcctgccccgttttattcccacgtgaagcatcagacccagggcagtgggggcggggagcagctgtgagattagcaggcccctgccctctctgcaccttcaagttcagccttctcccctgcccctgcctgtaacactgctagagtgcccctcaatcaggtaaatggtgtttgtggtcagcaaggctgtgtgcaaagcctgcgccgagagctttgtcaagcatgagagaggcaggtcactctgacatgtcaaggagtaatctcccatttacatggctaaaactagcaggaaggcaggagctggagtcagggtgtctgtactcttggagcagcccaggaaaggggtcgttgggtctcaggtggctctccctggtctgcagccagctatgcccaaatgccaaggacctgtggaaccat

SEQ ID NO: 92486 - DNA, 225 bp, Homo sapiens
aagccattttagaaaaaaacctttgaccagaaaaggacagggactttgtcaaagttcttttaagaatcattacaggttacatccacttgaaatttaggaagaagaacacctcctggattagatcctccgtttctgcaacgggcagccctcaagaagcaggcagaagcagtgcttaataaaacggtattctcagatgagccaatgttatggaaaagagttgtacca

SEQ ID NO: 92487 - DNA, 1037 bp, Homo sapiens
acttgtatacttgaaatcatttaatccagactgaagttgtaaaagccagccagtgttttcaatatagacttccatgtttgaccatctgaaaatgaaaaacactaaaaacatcacatgctgtttaggagctggaaattttaatatttgacttcaagtagatggtttttaactcctgaaatcgaactacgtttaagtttgtatgtttattacctgtttgagcacttaggtgcaattgtgggagcggggatgtcaagttcatttatgtgactctttggctcaacttacataatctttgttttgatatcacagttgtctaattattttactttgtagcttaaggcaggctgaattgttgataaaatggaaaaagtagtatattgttatataagcttctgaggtgtgttttgttgtataagccctggaggttaaaaagtcatcccttatgtatagtagttaaaggcataaaactgtgacttttagatattccacagaaccagacttatttgatgtggataataaccaatgatttagcattttgtttgcttttgttttattttatccgggttcattttttactcttcccatgtacatgaaacaggtggtggcgtgtagagatcagctgatccttgttttatggttaattgaactactttgtatccagggtttctgcaaatccaaaagtgatttttcatctaggatctattcctaacagtctactccaatcccactttagttttccacaattttaaatcttaatagtgagaattcaaatgaaagtcatttcatttgactattctgatgacatgattgtggcagaataaattgggtcttaaaatgccctagaaaatggtaaatgataaaaaataatattttaaaattcaaccaaagaaatggcccattggccaggtgtggtggctcacacctgtaatcccagcacttttggaggctgaggcgggtggatcacctgagctcacgagtttgagaccagcctacccaacatggtaaaaccccatctctacaaaaaatacaaaaaaaaa

SEQ ID NO: 92488 - DNA, 992 bp, Homo sapiens
acttgtatacttgaaatcatttaatccagactgaagttgtaaaagccagccagtgttttcaatatagacttccatgtttgaccatctgaaaatgaaaaacactaaaaacatcacatgctgtttaggagctggaaattttaatatttgacttcaagtagatggtttttaactcctgaaatcgaactacgtttaagtttgtatgtttattacctgtttgagcacttaggtgcaattgtgggagcggggatgtcaagttcatttatgtgactctttggctcaacttacataatctttgttttgatatcacagttgtctaattattttactttgtagcttaaggcaggctgaattgttgataaaatggaaaaagtagtatattgttatataagcttctgaggtgtgttttgttgtataagccctggaggttaaaaagtcatcccttatgtatagtagttaaaggcataaaactgtgacttttagatattccacagaaccagacttatttgatgtggataataaccaatgatttagcattttgtttgcttttgttttattttatccgggttcattttttactcttcccatgtacatgaaacaggtggtggcgtgtagagatcagctgatccttgttttatggttaattgaactactttgtatccagggtttctgcaaatccaaaagtgatttttcatctaggatctattcctaacagtctactccaatcccactttagttttccacaattttaaatcttaatagtgagaattcaaatgaaagtcatttcatttgactattctgatgacatgattgtggcagaataaattgggtcttaaaatgccctagaaaatggtaaatgataaaaaataatattttaaaattcaaccaaagaaatggcccattggccaggcgggtggatcacctgagctcacgagtttgagaccagcctacccaacatggtaaaaccccatctctacaaaaaatacaaaaaaaaa

SEQ ID NO: 92489 - DNA, 196 bp, Homo sapiens
aggctgggttcccctcacctcatctgtctttggcagatagtcccaaggcctcaccacactgagcccatctcccccaaacgtctggggtccctgtgtggtcagggccgtggggcctttacactagcaaccagtgccagcgcccacacggcaaccccctggctctccagggcctgctctgcgccctgacactaagctg

SEQ ID NO: 92490 - DNA, 196 bp, Homo sapiens
ctccagcctgtctcaaaaaaataaaataaaatgacgttgagacatcattcactcatacttacaaaaatccaaaagtttggctgggcatggtggctcatgcctgtaatcccagcactttggtaggctgaggcgggaggatcacctgaggtcaggagttcgagaacagcctggccaacatggtaaaacccctatctct

SEQ ID NO: 92491 - DNA, 213 bp, Homo sapiens
tggattcacaccctattctgttcagtttcagaggctgcagtcttcgcaagggacttggtgcaatttataagatggagagattaccattgtctggggagtaactaaaaaggtttcataagagaagtggcattagtgtcacttttgaatgaagagtagcattttggctggtgaggtagatgtaaatccaggtagagggagtataatgaacaacca

SEQ ID NO: 92492 - DNA, 365 bp, Homo sapiens
gagtctgtgtgccccataagtctgtgtgccccgcgagtctgtgtgccctgtgagcctgtgtgccctgtgagccatgtgccccatgactctgtgccccataagcctgtgtgctctgtgagtctgtgcctcgtgagcctgtgccccttgagcctgtgtgccctgtgagcctgtgtgccctgtgagtctgtgcccccgagcctctgtgacccatgagcctgtgtgccctgtgagcctgtgacccatgagtctgtgtgccctgtgactctgtgacccgtgagcctgtgacccatgagcctgtgtaccccgtgactctgtgccccatgagcctgtgtgacccgtgaacctgtttgccccatgagcttgtg

SEQ ID NO: 92493 - DNA, 261 bp, Homo sapiens
gagtctgtgtgccccataagtctgtgtgccccgcgagtctgtgtgccctgtgagcctgtgtgccctgtgagccatgtgccccatgactctgtgccccataagcctgtgtgctctgtgagtctgtgcctcgtgagcctgtgccccttgagcctgtgtgccctgtgagcctgtgtgccctgtgagtctgtgcccccgagcctctgtgcactgatctcctggtggtcccatgaatgtttgctccatgaagctagtgtggcctga

SEQ ID NO: 92494 - DNA, 438 bp, Homo sapiens
taagatgtatatatagcttatatatgtgtatatacacatacatatatatatatacatacatatatatacataaaatgattcttgcaaaagtagttatgggtatttaagtgaaaaatttgtaagtttagaagttaagaaattggaaataatggaattggtttaaaaagctagtctctaaattaacttagaaacctaatagcaaatacagattttgattgctataactaaacactttaattttgaaaaagtttcagaatagaatttctattcccaggggaaaataaacttcatttaaaaatatatgtatacttattttgtgagtatttttttcttttccaaattccaaaaggtgtatactctatatttttgtcataaaaattctgcttgtcgaaaatattgtagtaattttataaattcaataaaacctgagtgatgtga

SEQ ID NO: 92495 - DNA, 700 bp, Homo sapiens
taaaataacgacttgaggtttaattcacatgctacacaattcacatgtctaaagtgtacaattcgatggtttttagtatattcatagatacgtgcaaccatcagcatgaccagcttcaggacattctcatcatctcaaaaggaaactctgtctccatcagcagtcactccccgttttcccccaactcctccagccctgggcaacaaccaatcgactttccttagacaacgttttgagcccttattgggaggaattatagtcgaatggaaaatccagtttgggacgtggtgtaaactggaattgctttcgtggtttttccttgtgccttggggtggggcactgccataagagcattgcatccatcctttcgtcggtactctgctgcacacggatggcatttctgcccttgttacagatgaggaaactgaggctcagagacattaagcaaggggcagagtggggcttgtccatgagaccccagagtctgtgctcttgcacatacattatcaggccaacatgatctatccatccgaattccaaataaataaataaaaatgcttataagaagtccccccatgctgcggggaggcagcggctcatgcctgtaatcccaacacttagggaggcacaggtgggaggattgcttgaacccaggagtttgagaccagcccaggcaacatgacaatacctgcatctctgc

SEQ ID NO: 92496 - DNA, 474 bp, Homo sapiens
aatcaggaaagtaaagttttaaggattgacatgaaaggttttttgaaaagccctttagaaagcagattacgtctccatttggtcttttgattcttagaaatgttatgacatggttagttttgggcaagtgaaaagttaaagccaaaagagtgaaccttagtattaggttttgggggcagttcaaaaaagaaaagatagattagtcattagtaaaaagttagtgggttcggggcccagtcctggttcagctccagtctagcccattttcagtaagtagaagaaaagatagctgaaaattgactgtggcttcttgctttgttagtgttttttaaaatatatgggattatttttaattggccttctctggaagggctatgtcctttctgggaacattgccaggcagtttttctatctcctaaaagtggttaaatggtatagattgcctgtttaacctgatactttagtcttgtttgc

SEQ ID NO: 92497 - DNA, 224 bp, Homo sapiens
ttaagcaaaaactgaagatagctatttcctttttgagataactgtttcttcaaagcaagatatttgcaattttaaaaactttctctagaggcgggcagatcatgaggtcaagagttcgagaccagcctgaccaacatggtgaaaccccatctctactaaaagtacaaaagttagccaggcgtggtggcacgcccctgtaatcccagctagtcaggaggctgagg

SEQ ID NO: 92498 - DNA, 462 bp, Homo sapiens
atcacttgaggtcaggagttcgagaccagcctggccaacatggtgaaactccgactccactaaaaatataaaaattagccagacatggtggcgggcatctgtaatcccagctactcgggagactgaggcaggggaatcacatgaactcaggaggcggaggttgcagtgagccaagattgcgccagtgcactccagcctgggcaacagagcaagactccatctgaaaaaaaagaaaaaaagaaaaagaaaaatctttgcctaacccaaatcctcctatgttgtttcctagactttttttttttcttttaaataagagaccaggtctctctgtgttgccctggctagtcttgaacttgtgggctcaggtgaccatcccacctcctctgcttcctgcatagctgggactctgctctcagttatcctaggctttcttttctgtttttgaaagagtctcactctgtc

SEQ ID NO: 92499 - DNA, 253 bp, Homo sapiens
ctttaggaggatttcctgttcttttcctgtactctgctgccaaggagaaacctgtcttgcaccaggcctgcagcttcctcagtcccccacatcatcaggcaatatctgcctggcactcctctttgttccttttctctgaccttcctttttgacatgatggttgacctgaagtcaccgaggcaggactgctcatctccaggtcctatgggaaacagtacctggtgaaaccagagacaataatctccataacgca

SEQ ID NO: 92500 - DNA, 427 bp, Homo sapiens
gtatttctctcaaagaactactttttcatttttctcctagagtgataagcattatttggcaaacctgtgcacaattgtgtctgcaaacctcttgagtgtagcagtgtagtttgaacaagctgtcatttagcaaaagcagggagatgtattgtacatgagatgaaagaaacctgcctctggaattattctggggtatgcaatgtttgtcagttaaaatggagctgtttaaaagctgttttttatagtaatctacgtatctaatagattactagaccagattatcagtctttgaaatgaagcttcattaaaacagaattcgttgctgaattaggccaagataaatagctattctcttgcattttcaacttctactccagtcagagcagagttaaaaacaatctttagtctatgaggaatgatagccatt

SEQ ID NO: 92501 - DNA, 320 bp, Homo sapiens
caatactgtacatattacctccgaactaagttgaaacagctttctgatatcaacagcaactcttattcagacaatcaagaacagaatgggcatcaggcagagagcctaatcaaatacacctgactttctatatgaactacttaagaataaatctagtgaaagaagtgcaagacctctaataatctttttaaagcaaacttaaataaatacacaagtttatgaactggcacactaaattccaaagatgtcaattctccccaaacccatttactaattcaatataatcacaagcccagtaagtttgtgagagagagcaagag

SEQ ID NO: 92502 - DNA, 433 bp, Homo sapiens
gattgtaactgtgttatcagttgtagtgtctccttttccacttctgattttatttgggtcccctttcttcttctcttgattagtctaggtggtggtttagttctgttctgattttttatttgttttagagatggcatcttgcgatgttgcctaagctggactcaaactcctgggctcaagtgatcctcccacgtcagcctcccaagtacctgggactgtaggtgtgcaccactgcacctggctgtctgctctgatctgcaccactgcacctggctgtctgctctgatctttattatttcttccactaattttggatttggtttgttcttgcttttgtagttcttgagatgtgcattgctagattgtttatttagactctttaagctttttaatgtagacatttattgctataaacttccctcttggcactgct

SEQ ID NO: 92503 - DNA, 566 bp, Homo sapiens
cctcctctctaagaactgtcaaatgtacagaaggaagcaagacaaaacaagatatctgcctatatttcaacacggatgtagaaacctgcctgtgtttacagaagcacttcagtttgaaacaaatgtaaacttaagattgcttcagagtacacagcgggtgggtgcatgcccgggtaactaccatatgctctgaaaagtgagatgtcaaaaaggtgtgacagcaggcatgcccttaggtgctcaaataaggaagctggcatgtgtgttactctcagccttctcaaaatggcccccagtggttctcttggggcagctattcatttaggagagggagggtcttctgatgtgggcgaaacttaagaacatgaatggcagggctgggcgtggtggctcatgtgtgtaatcccagcactttggaaggctgaggcgggcagatcaccagaggtcaggagtttgagaccagcctggccaacatagtgaaaccccatctctactaaaaatataaaaattagttgggcgtggtggcaggcacttgtagtcccagctacttaggaggctgaggcggg

SEQ ID NO: 92504 - DNA, 442 bp, Homo sapiens
agaccagagaagggtgatgacttttaccaagcatactgcgtgcaaacacatttttaacaaagcacatcctgcacagccctatatccattaaaccttgagtcaacacagcaaatatttctgtgaccacagggttggggctagcgttacagattaatagcatctcaaggcagaagaatttttcttactacagaacaaaatggagtttcttatgtcttcttctttctgcatagacacagtaacagcctgatctctctttatttcccccacagtcttggcaatgtgggctcttttttggttccatgtgaactttaaagtagctttttccaattctgtgaagacagtcattggtagcttgatggggatggcattaaatctataaattacctggggcagtatggccattttcatgatattgattcttcctaaccagggaacggggatg

SEQ ID NO: 92505 - DNA, 543 bp, Homo sapiens
atccaacagatatttttgagcacctgttatgcacaatacatttgggacatggtagtgaatacttctatgaagaactatacatggaaaaatgagtatattctatgcatagtgctccacagaattctttactactatacgtccactaattgaggacagaattcttgccctcataaaaccatttataatgctagtttgttggtaggtattaggccctatgttaaaaatgaaagattgaacttagagctgccaagcggcttatacaaattgacctagctaagttgcagagcagtggcttcacctaggtcttttgattctacatttctgccttttccccacttctcaacactgttgattattctgattaggaaggattaaagtagtgaaagcctggaaaagggagaccagatatgactattgcactagaaaattaaacaggctgtgggagacagtactaagatggcaacaatttgggatgaagagaagacaacagaatcaggaagaaggaaggatcagtgggatttaataattggctgtgtcaaggtt

SEQ ID NO: 92506 - DNA, 2529 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92507 - DNA, 756 bp, Homo sapiens
  misc_feature (628)..(628): n is a, c, g, or t
  misc_feature (737)..(737): n is a, c, g, or t
tgatctagagcgatccgtgatcatcccccttcgtaaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggnagtttcaaggagcaagggcattgtttttcccggcgacaaagtttccatttttggggggaattttttggcgggggaaccaaggggcattttttaaaccatttgggccccnagggggtttttagaagcaa

SEQ ID NO: 92508 - DNA, 2473 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcgtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92509 - DNA, 2529 bp, Homo sapiens
gaggagcggcccggggctgcgtagctccgctggaccccgattccgggcagagacccccccccgccccggcccgcgcgcaccgagcccagcccccgccccccagcgcaggcgcagcgcggacctcggccccaccggtcccgcgcccggaccctgagccctgcccctgggaacccgagggccccgactccgactgaccctgacctgggacggcgcccccgcctccgccctgcagaaggggcgcagggaggggccccgaggccttcgcgcggccccacgcccgggaccctcccgcgcccggccccacgcgcgtgtcctctgtccgcagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92510 - DNA, 2027 bp, Homo sapiens
ggctggtactgacccgggaattatgggatgtggggctgaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92511 - DNA, 2644 bp, Homo sapiens
  misc_feature (2515)..(2515): n is a, c, g, or t
  misc_feature (2521)..(2522): n is a, c, g, or t
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaaaaaaaaaanaaaaannaaaaaaaaaaaaaaaaaaaaaaggccgcgtttaaacgtggaaatggaaacctggcgtacccaactaacgcttggagcacatcccttttgcagtggcgaataccaaggccccacgatcctttc

SEQ ID NO: 92512 - DNA, 2794 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaaaaaaaaaaaaatctgctcctagcccagcagagagagttgacccctcctgaactggccactccccagtgctcctgtgcagggagaggaagcaccccgtttgagagtgtacccagtcagactggctttatctccatggattttcatcagggcaaagatcacagcagtcagcttctggtggctgatgaggatcagagcatttgttcccccatgcctgcaggactcagcctgtacagggagatgaagtgccccaagttgggagcacacctagttagaggtattggtgttaat

SEQ ID NO: 92513 - DNA, 1993 bp, Homo sapiens
  misc_feature (1865)..(1865): n is a, c, g, or t
  misc_feature (1974)..(1974): n is a, c, g, or t
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggnagtttcaaggagcaagggcattgtttttcccggcgacaaagtttccatttttggggggaattttttggcgggggaaccaaggggcattttttaaaccatttgggccccnagggggtttttagaagcaa

SEQ ID NO: 92514 - DNA, 1625 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgaggaaggtgtcttgagattatcatcggctgatggttggaagcggaatccgcagacgctcagcaggtatcttgatatcatcatctgctgagagtggagctgagggtggccggggagtgagctgacgctcggaaggtgtcttgagataatcatccgctgaggg

SEQ ID NO: 92515 - DNA, 1248 bp, Homo sapiens
  misc_feature (1185)..(1186): n is a, c, g, or t
  misc_feature (1209)..(1209): n is a, c, g, or t
  misc_feature (1221)..(1221): n is a, c, g, or t
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctggggcatnntagagaagggccctaaatcaggngctcagtgtccngaacgcagtctatcccacccaccagcc

SEQ ID NO: 92516 - DNA, 2138 bp, Homo sapiens
ggcctccagcccaggacaggtcacatgggtggcggtggggcctgagtaagggcgtctttatacttccgagggagtatcacggggtagggtcttttgtagggttgggatttggaaaatagtgggcctctgggggctcacactgggcaagagagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92517 - DNA, 2427 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtgcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92518 - DNA, 1847 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92519 - DNA, 2356 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92520 - DNA, 1765 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgaccaggtagacctaactgaacttggttattgctgcacctaataatcttctattaagaaaactaggatacgggagaaagagcactggcctgggagataagactcctgagttctactatgagtaattccatccacaaagccagtgacctggtcaagtcacccacctgctaaggcccagtctcttcccctagcaactgaggcagcaggagagaatccctgcaggctgttcctgcattactacgattctcccaggtcagatctaaggggcgaatcagcagacacttaaatgagagaacagaggtg

SEQ ID NO: 92521 - DNA, 851 bp, Homo sapiens
tgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccttttttttttttttttt

SEQ ID NO: 92522 - DNA, 2347 bp, Homo sapiens
tgagctgagatcatgccactgcactccagcctgagtgacagacactttaaaaaaaaaatagattttgctattgggtaaggtatagtagtcggcagcagaatggactgattgaggacaactataaaattacaaaaaatatttaaatgcaacttattgctatagaagcaaagagaactaaaggagcaaaattctagagagtggtaaatcccagaaagcacatgcacagaatgcagctctttgctctggggaccctttccacttctggctatagggaagaacctgaatactgaacttggttcaggcagagggccataccctgggggtcaggggaaggcatgggggggaccagaaaccaggagaacaatcaagactgcaattaaaaaaaaatggatacattaggggcttcaaacacataatttctcaagaaatttccagatatctcatgctgcatagggcaggaggctgaaaagctaatttgagaagaaaacaagtaggatttttgttttgttttgcattttgcaatatggaggagaaatgattagaccttaggaagtgccagtgggttggtcctttcatgaacatgccatcagtaaaagccctggaaacaaggtcataccagagattcattgtaccttgtcacaactgcaaacaatatctgagtggaatattcaaaaacttgcttagaaagaaaactctaggacagatggctccactgaagttattccaaatatttaataaataaagcataccaggcttttataaactcttctagaagaaaaaagttggaacttttccaattcagtttttcaggccagtgcaaccttgataccaaaaccaataaaacaaacaaacaaacaaaaaacataaagctatagaccaaagtctcatagatttagatgcaaaatcctaaaattgaaaaaaaaagtctagtcatatccataaactgtatcatcaccaagagatgtttattagggcaatcaaaagatgatttattattttttaaaaaatcaatgtggccttcccttcctctttcttttgattcccctctttgagtttttatgtgtctcttttgccttcccttcccagagtggaggagttagacctgcattgtgggatgagaggagttgtggctatgtgtctgctggcaccaagagggctgagggtgaggtgtggaagggacagggggaggagatgggcagcattgttaagagattggtaccactgagcaaatatgttgagaatgatgatggcaaggtttctccctgttagagaaggtatttgtagaaataggaatgaggagagctagaaaacctggagtgtgggattagaatagaactcatatcttttaaatacataggaacaatagagaaattgttgggtgtgcccatatacatatattttgtgattcattctaccgagaggacataaatgcagtcacagctcagtaacagtaaacacaccaactgccaagttattatttcctaaatactatccacaaaaaaggggaccagggatgattcctagtcggagattgggagaaaaagaagatgagcctgaatcatttcatgtacctaacagaaagaaaatactctggctgggctcagtggctcatgtttgtaattctagcatgttaggaggtcgaggtgggtgtgttgcttgagcccaggagtttgagaccagcccaggcaacatggcaaaactgtctctacaaaaaatataaaaattagccaggcgtggtggcatgcacctgtcatccgagatactcaggaggcagagaggtgggaggatcacttgagcctgggagattgagactgcatcgagctgtgatcatgccactgcactccagcctggaagacagagtgagaccctgtctcaggaaaaaagaaaaaaaaaagatgttgctcagcaagttaatggacaaactgtgcaatatccagaaaactttaacattcttcaaagaaatagaaaacacaatcctaaaatttatatggaaaccacaaaagacctagaatagtcagagttatcctgagcaaaaggaatcaaactggagggatcatattacctgacttcaaattattctacagagctacagtaaccaaaacagcatgatactggcataaaaacagacacataggaacagaatagacaacccagaaacaaattcatacatctacagtgaactcacttttgacaaagttatgaagaacatacattggggtaaagatagtgtctttaataactggtgctgggaaagctggatatccgtatgcagaagaatgaaactagacccctatctcttaacatatacaaaaatcaaaattaattaaaaagttaaatctaagacctc

SEQ ID NO: 92523 - DNA, 913 bp, Homo sapiens
agcttgcatcctctagagcggccgcctactactactaaattcgcggccgcgtcgatatccacaaaaaaggggaccagggatgattcctagtcggagattgggagaaaaagaagatgagcctgaatcatttcatgtacctaacagaaagaaaatactctggctgggctcagtggctcatgtttgtaattctagcatgttaggaggtcgaggtgggtgtgttgcttgagcccaggagtttgagaccagcccaggcaacatggcaaaactgtctctacaaaaaatataaaaattagccaggcgtggtggcatgcacctgtcatccgagatactcaggaggcagagaggtgggaggatcacttgagcctgggagattgagactgcatcgagctgtgatcatgccactgcactccagcctggaagacagagtgagaccctgtctcaggaaaaaagaaaaaaaaaagatgttgctcagcaagttaatggacaaactgtgcaatatccagaaaactttaacattcttcaaagaaatagaaaacacaatcctaaaatttatatggaaaccacaaaagacctagaatagtcagagttatcctgagcaaaaggaatcaaactggagggatcatattacctgacttcaaattattctacagagctacagtaaccaaaacagcatgatactggcataaaaacagacacataggaacagaatagacaacccagaaacaaattcatacatctacagtgaactcacttttgacaaagttatgaagaacatacattggggtaaagatagtgtctttaataactggtgctgggaaagctggatatccgtatgcagaagaatgaaactagacccctatctcttaacatatacaaaaatcaaaattaattaaaaagttaaatctaagacctc

SEQ ID NO: 92524 - DNA, 2215 bp, Homo sapiens
  misc_feature (814)..(814): n is a, c, g, or t
aactgtttcagcatagatttttaaaaatcatgtgtgtaaaagagaatgaaatattaattatgatatttacaaagctctgtacattcagaattgaactctttctgcatctcttttttgaatcagagttgtcataaaccacaatttttcacggtaacaccctctctgccatcaggataaataacatttcttaaaggaatattctactgcagtctctgagatttttttccctgtcttagacatccattctacaactctgatgctggcacattttttatcttggcaaaaggacttaatagaaaaattttagataacaatcaggattcatactcttctcaatagtccttaaatggtttattgaccaaaaagtaaagaagtaacagtccagtcatatcatggaaagaacaaccaaattcatgcatgcacaggcaaagacaaccatatcactatgaccacctggctgacagtaactgcaggacatcaattattgtaagacacttcctgtaatatgtttaattcctctgacataaggatttatgtgaattaggaagtggcccaagggtgaaaagtaatagggaaatagagaaatagaaccgatccaaaggaaagggggaaaaaaacccacaaaaagtgtgatgtcaagcaaagcctattctggagatgactttggttcactcccacgggagagccctagagacaaaaaggttctacagtaggttcaagtcagaggccagagaacccagagtatttatacctctgcaccatcagttattgaatgggggtgggggtgggggtgggtgtaaatttccaggtgctnccagcctgcaatgcagtcaaagcatgttcctgtagcctgaggacagccgtccaacaaagaggtgcaggtgctgaatgttgagagtgaaagcacagggagctgtcatgcatgagagtggtagagggatctgaaagtgctagcagtgcctattatacatccaaatactaaagacgcttagatgtgaaaaatgtgtgtcttagaatcgataaaatatggtatagagaatcaagtctccttgttcctggtttatctcatagcatacttaaaattcagctaaagatgaaatgccttaacaagtgaaatgggctttctgaaaaattatttcaatcaaaattgtgttaaaagctatttctaaaaaccctaacattaaatacttagaagagatcaagtggtttgtccctggacattcaagcaattgaatgtctaaacaatccaagacagataattttgtagtatttactgtgtgaagtgaacctttaaggctgtggacaatgcaaactccctcatgtaccttgctccttgccaatttcaaacaaaccttctcacctatgatataaggcttccttagaattattgattaattatttaagatacaataaaaccaaagtatttttaaaacacagtaattatgttagtgcaggtacatgacatagatatcctcaaatattcttaggacatctataaatcaccacaaacattctggaaagcagtcttggaacatctatcaaaggccttaaaaatttcttcttctgtgaatttatcctcacaaatgaccccaagtttagaccaaaataaaaaaatgcttaaaaggcttattaaagcatgatttaaaatagaaatgattgcgtaaattcctgaaaacaggggaatgtctaaataaaatatggtatctaacatgatagaaaatgtttactaatgtttaatgataccaagaaagtatcacaataataacatcaagtggtaataacaggaaacagatctgtatacaatataaaaccaacagtattgtatatataaacaccatagaagatctgaaaaaaaattagatgacattatttgtgatatctattttatttattatatttttctgcatactactctacagtgagcatgtcctttataagaaaaaatgctaatgatttattgtgtatgaaaaaagtgtatctgatttgattatatatttttatttccacttatattttctaggattattttgctttagaattctatgtataatcctgtgaaaatttgtagtgttgtagggactggaaagatcagagattatgttatggccatgaatgaggcctgacctgcattgtcaataactaaattgattattgtggaaacaacaaaaaaattcattttttgaaatgaaaatctttattgaaataaaaaaattac

SEQ ID NO: 92525 - DNA, 416 bp, Homo sapiens
catgagctactgaggccgtcccaagctatttaaaatacttcagaattactttataccaaagcaagcaatcttagagattcttacaagtctacaaattaaaagatctagaagagttcacagtttcagccttgagttctgtctcagtccagactgtgggatcattcctggacttttccttgctgagccagctgccttaaaagaatcatttggcaagtcattcagccagtctctcagctgctcagtggcaagatgggaagcctaggctgagattttcttccctgacactctttagggagattgtgggacaagggggaaagtgggtagagcaagactgagtgaacctcctcatgctgggttgtgtgagagatttacatgcctatagtcaattcattctaacatccacagaatgcagatat

SEQ ID NO: 92526 - DNA, 337 bp, Homo sapiens
tacatttcaaatttgactgaattggttcttttaatgctttacactctaccgaagtataaaatactgcactgaccatgtttgttttgtttctggttcagatatttctagtttattctcagttttcttcgtttgtgaaatagagataataagtattactgagtaccatccatgacttttagtggagagatgccatcttgatgactgaaagctaaaccagagttttcttcctcattctcattacttagaaacctttgctgatgattaggtttggtgccctaatgggacaattgagactaacacggtctataagataacttgcttcaatttaaaaaggcaa

SEQ ID NO: 92527 - DNA, 667 bp, Homo sapiens
ccacagcctcctgggtagctgggacttcaggtgtgtgccaccacgcctggctaatttatgtatttttttgtagagacagggtctcactttgttgcccaggctggtctcaaactctcctgggttcaagtgatcctttggcctcccagagtgctgggattacaggtgtgagccaccatgcccagcctttcctcttaagttatgaccacagaggttgttaggttaggttccactctgatgactgcattttaacttaatcacctcttgaaagaccctatctctcaaatacactcacattctgaggttctggggattaggacttcaacagatgaaatttgtaggggacacaattgaacccttaacggcctctgagtgggaaggaagccgacttggagtctggctttcatttctaggcaaatacaagttggaactggggcccaggtacctctgggagaagcttgtggtgcccctgccaatcagagttacacacgaggtggctgtcccgggcttcctccgtccaggcaggctcagcttggcctcctcccagcctcagagtcacaggtttagacaggaggggccttatgggtcacctgctctaacccacatccccaccttgcacccccacccagcacctgtcatggcaccccctgaacatgagcactcaccttct

SEQ ID NO: 92528 - DNA, 329 bp, Homo sapiens
tcgtcggctcgggacccccgctggcctctgagtgggaaggaagccgacttggagtctggctttcatttctaggcaaatacaagttggaactggggcccaggtacctctgggagaagcttgtggtgcccctgccaatcagagttacacacgaggtggctgtcccgggcttcctccgtccaggcaggctcagcttggcctcctcccagcctcagagtcacaggtttagacaggaggggccttatgggtcacctgctctaacccacatccccaccttgcacccccacccagcacctgtcatggcaccccctgaacatgagcactcaccttct

SEQ ID NO: 92529 - DNA, 485 bp, Homo sapiens
caagaactaaactgctggttatgatgtggtataataggcactactaattcatctactaatttaaaattatgaaaaaaataaaaaagcaaacctattgacaggaaagagagaaggggaggaacggaggtaaaaacaaaagaagcttctgtagttttccatttaaagtcctgccaaacttctgtgctcctctggatgtgtctggatttccagatgttctgcagtggtattaatctggcaggtacggtagttcttctactaataaaacagaattagactgtggtagtcccttaattcattattcaccctgcattcaccattgcctacctaagtttcatactccatccaatatccaaattgatatttttaaaacacaaatttgcagatgcttttcttgtacaagaacaccttaatggtctcctgttgcttaaaagataaaatacaaaattcttaacattgctactcaaccctgtgtgatctggcctccg

SEQ ID NO: 92530 - DNA, 346 bp, Homo sapiens
gaggttgagggctgagaacaacaccatgcttatggctgtgggagcaaggagggataagagatgtttgtgggtcaggcactgtggcttgggctaggtgcggtggctcatgcctgtagtcctagcactttcggaggttgaggtgggcggatcacttgagcccaggtgtttgagaccagcctgggcaacacggcgagacctcatttctataaagaaatacaaaaattagctgggcatagtggcatgagcctgtagtcccagctactcgggaagttgagatgggaggatcacttgagcccagaagttcaaggctgtgagctgtgatggcgccactgcattccagcctggg

SEQ ID NO: 92531 - DNA, 503 bp, Homo sapiens
ttccccaaagtaatgggtcaaaacaacaaatactcattatctcagggggtttctgtgtgtcaggaatttgggagcagcttagctgaatggttctgccctggggtcttctcataaggctgctgtcatctgaaaatgacgggctgaatgatccacttgcaacgtagctaactcacatggctattggcaggaaacctcattccccacctcagctctactccactggtctgcttgaggctcctcacgacatggcagctggttgcctccagagcgagcaacctgagtcaaggaggaagctgaaatgcctttcatgatttggcctcagaacttacacactgctcacttaggctgcgttttgttagaatgagtcactaattcacaattgtaaagatatggaaccaatctaaatgcccattaaccaatgagtgcataaagaaaatgtggtatatatgcactatggaatactactcagccataaaaaagaataaaatcatgtattttgcagc

SEQ ID NO: 92532 - DNA, 108 bp, Homo sapiens
ccagacctcttcatctcccttctgcttcacagccactgttgcctacctggtctcccagcctcagcatcatccctctaatccattcttgcgccacatcagagtgccgtc

SEQ ID NO: 92533 - DNA, 383 bp, Homo sapiens
ttcctcccaaagtgctgggattacaggcgtgagccaccgtgcctggccaaaagtctttttttgagattaaaaacatccagaaagcagccggacggacatttccattgtattagtttcctgttgctgccataacaaattatcacaaatttagtggcttaagacaatatacattattatcttacagtttggaggccagaagtctggaatgggtctcactgggccaaaatgtatttcagcagggttgtgtttctttctggaggctctagggaaagatctacttccttacctttccagcttctaaaggctgcccacactccttggctcttagctccttcctgcatcttcaaagccagcagtggctgattgagtctcacctctcatca

SEQ ID NO: 92534 - DNA, 290 bp, Homo sapiens
tgtattggtggtgcttgctgtttcctgttgctgccataacaaattatcacaaatttagtggcttaagacaatatacattattatcttacagtttggaggccagaagtctggaatgggtctcactgggccaaaatgtatttcagcagggttgtgtttctttctggaggctctagggaaagatctacttccttacctttccagcttctaaaggctgcccacactccttggctcttagctccttcctgcatcttcaaagccagcagtggctgattgagtctcacctctcatca

SEQ ID NO: 92535 - DNA, 398 bp, Homo sapiens
tagactataatccatacattcaagctgatatagctatagtaaccactgtttcattctctgtgtaatggatgtaatacacagagatacagaatgaaacagtggttactacaggtcaggggagggaaaggaaatgggagatataggtcaagaggatacaaaatagcagatatataggacgaacaagtctaaatatctaatgtaccacataatgcctaaagttaatacagttgtgtcttattagggattttcgttaaataagtagatctttttctgatgccttttcctcctgcccaagtcaaggggttagagaagaaaaccatgggttcaaagagtgaactgtccctctgttagtgagctgagtgatttttgataatttactcacttgtcttacttgatga

SEQ ID NO: 92536 - DNA, 371 bp, Homo sapiens
ttttttttctgagacatgatctttccccattgcccaggctggagtgcagtggtgtgatcatagctcactgcagcctcaagtgatagctcgtagctcactgggctcaagtgatcctcctacctcatcgtgagtagctgggactacaggtgcccctccaccatactcacctaatgttttgaatattttgtagagatgaggtcttgctatgttgcccaggctggtctcaaactcctgggctcaagtgattctcccgccttggcttcccaaattgctgggattataggtatgagccaccaagcccagccctgacctgattaataacacccaagacacacagaggtgggaccgtaacatggggagcatcacgtcct

SEQ ID NO: 92537 - DNA, 442 bp, Homo sapiens
gacacagcaggcccctgcccctgaaggagactgcattggaatttttgccaggtggccctgacacataggaatgcccaactactgtgactaccctctgagataaaaagctgtcctactgattttagaaggccaaaattagaggtcattttggaggtcatgccagtggacatataacagtttgaaatgtttgttccccggtgccgtaaagaaatagtacttgaacttaaatttattcagcaaggccatttttattttctgcagaaagggtacacttggcagcagttttgccacgagagtaccccgaacaaaggagacagggtcatttataacctgacgcgtccacccttctgctgtgtccggtttccattggctggaacaggacctcacattctgtatttgtcccgattggctagcaacttagaacttattaaaagaggcaaag

SEQ ID NO: 92538 - DNA, 414 bp, Homo sapiens
tttttaaatgctatagaaaagataaatatatttagatctattaataatgaaaaaattggggaaacatctttctaaagaattattaaatgattttcatctacaaatagtcatattaaacagttcaaaattacctcccagcttgtcactagaaactggggttactaagagttaaaattcaaattaacacatgtaattaaaactactaaactaaaagaaataattctatatgcaaggtatataagaaaagcgagatatgtttttgattatgaaagttataaaggcataaaaatgtacatttgggaaaaaaatttgtctagtttagaagttatttaaaggttgcttcctattgaaagaataaaaattatatagataaaactaaatgaacatagaaaggtatgaaaagaaagaatacaa

SEQ ID NO: 92539 - DNA, 293 bp, Homo sapiens
tcaagcttatgttctgttgagaaataaataaataaataaaaataaaccaaataaataaggaaaacgtataatatattagatggtgataagtgctaggaggaaaaataaagagcaagggaaaaagggaacatttggggggcagtgacccagatggaacaattttaaatagggtgacatttgaaaaaagacctgaagaaggtgagctaactagccatacacacctctgggggaagaatggtccaggccaagggagcaggcagtagggagagcttaaacaggaagcatgcctggtg

SEQ ID NO: 92540 - DNA, 469 bp, Homo sapiens
ttggagaaaatcagatatacaaagaaggagtggatgggaatgatgagaaaaaggaaataagaggggaaaattaaggatcttgcggaaatgaaagaaaaacaagacaaccagcctccctcatctccctctatccattaaagaaacttcagaagagggcactttgaagctatttgtgatattactaggaatagaagagaacagaccacatccatataaaactactttacaaaacagaaaatgcaaatcagctcatttcaggtaatgaaaatatttcccagaaaatcagtcacaaagcagaagaaaattgtaacataacattccaaactgaatcagatatcctcaaacagttaaggaggatatgaaaaaaccatgtttaatcagaaatactaaaatcaagaacagagatggaccaaaaaaccccacaaagaaatgaaaccacaactgatttagctcaggatagaagtaaaag

SEQ ID NO: 92541 - DNA, 492 bp, Homo sapiens
cagagcacaaaagccatacagtacagtctaatgtatgcgtctttcctgcagaatcctaatggtgctgcactgaggggaatttacacaaaccttataggaattaaaaagagacatttatttcattcagagaatgcagtgacttccagtgcttgtgcggctaggaaagctcggctttcaaagggccttttattgtgcaggaagaaagcgcagctccagcgccgaggggacactttggaggccggctccgcgtgcctagcaactcctgggagcgcgctgcttttcccagtgccctgggccgggtctttccgtccatccttaattgattgggttaatataaaccccggcacggccggcgtttgtgcggcccccataataagactgttgtgggcttctctctgcccttgtgtccccccattaaggaatgtgtcactccgcacagttcaaaagtgtgagcaagtgaaaagggccacaatcacttcattaatgatttgt

SEQ ID NO: 92542 - DNA, 279 bp, Homo sapiens
ggaaagagcactggaccaccatgtgtattcattcactattttttggtataactgatatttattgggtacctcctctgtgccaggcactgttctaggcacttgggcacagtggtcagtaagacacgcaaagtcaacaaaataacagtaaaataaaaggcatgtttggtgaggtatgtgctgtggaaacatgtaaagtaggtggggaataaggatagcaatttgaaacaggaagttcagggaatgtctgtataagaaggatttgaaggaggtgaaatgtgg

SEQ ID NO: 92543 - DNA, 562 bp, Homo sapiens
ctccttttatcttcttcttcttcttttcaggctttccttacgcttctttaatactgacttccgtagatcttacttccaaccccctactccccagccccccacccgcacctatctactgccgcccccttgcctcccacacacagatgtgacacttttaatgcacattctgtagccctcatttttccttctccttagactctgctatgggaaatcttggtccctcactgcccccattcatctgcctctctgtttgcgtttacatgacttgagtggcctgtcagtcccgctagtaaagtctcctcatccatccactctgtttaaacaatcaaactctgaaacctgtgtctcctggaccatcctataatccctaaaataggctgttatgcttttcacctctgccctactctgttagcactaccttacttattgacctctttcaatcaaatcgttatctaaaggatacctgtaactcagataggttgcctactgggcctgtttagttttaagtaaaccccactgaatatgagagacccaccctctatttgtatgtagaggcagattg

SEQ ID NO: 92544 - DNA, 367 bp, Homo sapiens
ctcagtacatcatgtgcatttaatctattttctcaggccctgctcctagggaactggacctaagacaattagtcgtaagataaagtcaacaggacatatcaataagctcaacttgatagagctgcttctctgagcccagcactctgccatcagtgtgtgggtgtgcaatgacatgaggagcagcttctgctcccatcaagcttaccatgtagctcggaagtgaaaacataagagtgtgtacaatgtaagttgcatcataatgctagctctagataccaaattgacaagtggtaaaatttgaggtcagcaaacaggagtgttttcctcagagatctccataattgaaagtaagtatcaaaatgcttgt

SEQ ID NO: 92545 - DNA, 771 bp, Homo sapiens
cacagttctctcgtcagtcccatcccctcctgcttaagcttctgcacaccctaccataaaaacaagtccacttgaagcagctttattcataaccagaacctgccctccacacttcctcagatcatgcaccagggttgtggcttcacccagatggtagctgtggttgatcaactcaaccaaataattagtattgattggtttattttttttagtttccatggatgttcattttgttagagtacagtattttgcctcgctctacagcctgcaaatttaatgtataaaagtactccgttttctatactttttggaacttatagtgtagctgcacaattcctttcaatcccaactcagattagttgttagctaaaagtatatagaagaattctgagccatggtaagatgattcttttttaacattaattttctgaaaaaatgttgtatccatgtagcactaaggaaggagtttaaacattcacatgtagtacgtgtgcacacataaaatcactgcctcattcatgtgactttaagcaaatcacgtcatctctttaagtttcatcttcattatcgaaaaaactggtactaataatactcgttctgtcttcttagcggggttgttataaaataaatataaagtaattgtccttgagtacaatgcaaatgcaaatatcctccaaatgcggtgaaagtattttagacatgcaaggggacatattaaatgatttggggatggacagaagagcccttgaaagatggggatatcatcatcca

SEQ ID NO: 92546 - DNA, 298 bp, Homo sapiens
gtgtcagtagcataatgtattttcttcactggcatttagcatacttttaacctgtggtagcccataactctttactgtgtcagggccgggttccgtgcacctcctttatcagcctacaacactacgatgcccccagcctttccagtgccgcctcttcctgcccagcccagttcctggcccagaggccatggcagtttgcatggaagtgctgagtattgtttcatgtttgcaaagagaggacagctgtggatgaatggagaggaaataggagaaagtcattgtcagagactcgggattt

SEQ ID NO: 92547 - DNA, 421 bp, Homo sapiens
aaagtagctgcctcatagggtcataacgagaacaaaatgagtggatgcatatagcattaagcctaatacttggctcatataatgaacccagtaaatggttgctattattactataacaactacttctattactgttggtgctactattactattactactcttactactaaaacaagtactgttattcctcctcctgccagcaccatggggattacacaattcagctgaggacaggatgatgaatcactggcgactcagtcctctcccacgaatggtactggagtgcttgaatttgccagcacttttgtaaggagctgggagcaaaggctgagaagacacagtcactgcccagacacagtcactgccctcatagactgtgaatctagtgtccaacaaaggcatgactcaacaaacaaccag

SEQ ID NO: 92548 - DNA, 236 bp, Homo sapiens
gccagacctatctagctaagctgctgttgaattcttggaccatagagactatgagataatgaatatttattgttgtccagtgcagctaaaaattttggggtaagttgtttcatagcagtatataattctcttctgaagttgtgctgaaggggaaatttacacccaattcatgtattagaaagaagctgaaattcagtgatcacaagtgtatttctcaagaagttaggagaagaaca

SEQ ID NO: 92549 - DNA, 292 bp, Homo sapiens
taattattgtaataatacaacactaattattgtaaaataacacctataaattagtaatactttattattataaaatacagtcctatttgtattgtaacactccaacttgtatgtcggtgtaacttttaactttctggaaattcaagctaatctcaaaaggtatctctaaactatgggaggacttaattcttcttccacctttaagtttcacttaagtctcacctttcctgcaaggaacaacaaaagacaatagaaaacatggcagcatttgcttcttcctcatcagagtgtt

SEQ ID NO: 92550 - DNA, 396 bp, Homo sapiens
caaaccaaaagtaaataacctttagattatattgttttagctgatttgtgtatcacttccataagtatagctaatcgttgagtatagcttttattggacactgatttttaaatcagggtatttgcattaagaatacttaaggttggctgggggtgtggtggctcatgcctgtaatcgcaggccgaggcgggtggatcacctgaggtcaggagatcgagaccagcttggccaacacggtgaaaccccgtctctcctaaaattacaacaaattagctgggtgtggtggcatgtgcctgtaatcccagctacttgggagtctgaggcaggagaatcgcttgaactcaggaggtggaggttgcagtgagctgagattgtgccattgcactgtagcctggg

SEQ ID NO: 92551 - DNA, 472 bp, Homo sapiens
ccgatggatagaaagacagataaatatcccgatagcctactatcagcatcctactactgcttccctaaagcagaattgttattcatttaagaagtctaatatgatatacattcatcctagtataaataaataatctctaagttttctgaaatggaatatttaacgcacatagacagtggatatttactttaaatataatgttattaatcctctgcatttcttttatcttgataactcctagtgagggaatctaattaagatttcatgctgttctttgtaatgataaatgtttccggactaaacactctataatacaaatcaaaaaatcttccttcttataactgagaaatgtttcacccaaatttcctttgttattatatatttactacacatgttgaatttattattgtttatttccaaggcatgtattattcaatttctaattaaaatatatcagggcttatattttgca

SEQ ID NO: 92552 - DNA, 381 bp, Homo sapiens
ggggactctgggcagggaagcctctgaccctgtcctcatggagctcaccatgtaggagagagatgaagacagtactccgaggcaccaggcaggatttgcaaggtgccatctaagcagaattattctagagaatcccaaggtgctcaggagggagatcattgttttccctgaggcagtaggaagggcaggagatgcaagaacaggccctggactcaggcagacccaggttccaaccctgcttgcacactctgaactgggtagctttgagccaatcactggttgtctcatgcagaagatgggctaccagcacccaccccagggatgctatgggctgacaaccaacatatcatctatacctgtgggtggacttgcatggaatcg

SEQ ID NO: 92553 - DNA, 332 bp, Homo sapiens
gttcagaaaggaaacaaggaggagagagtttgagaggggagagatcataaaggcaaagtgtgaaaagatagagaacaggaagaaaaaagccacaaccaaaaactatgaaaacagagtaaagacagacagccctgtaatgaaaatgctcaggataccaccaaatagaaactccctttgtttactgctagtcattgcagctgcttccaccccaaagtaatgagaagggagaggtttttctttatgcctgtgaccttggttttgaagctttgcctcatagtgctctggtctgccatagtagacattagcatatatcattatatgcttagtcagcc

SEQ ID NO: 92554 - DNA, 530 bp, Homo sapiens
tacacttacaaaggcatatgtgcatttggaattctttaaaggacaacatcctcgagcttctcctggtagtatactctagatataacgtagtgtttgggcaatttgggatcaaataattcttacagctttatagaatcccttgtgtaattaaacttgaaccttgtataacttatgtaaaggtaccaaatcatctcttactcacagcttgcctccccctgagaatcataaatgcaatctttaaaaaccatttaccagcaagaccaaagctaatctgtaaggttggggcctcaaaactcaattctctatttcctttggaacatgaaagatgcagaaactgcctttttattgttcatctgacttaggtgggccccagggttttgtcctatttcctagatgttgatgagcttcttgggtttctttgatgattgcttttgctcttcagtggtcacatttggccttactcagtgtaggggtgtggagaggtggcaatttattgcttaaagatgttatagcaggtgttcctgggcgca

SEQ ID NO: 92555 - DNA, 512 bp, Homo sapiens
gtgaagtgttcaggctgtggagtcagacagacccaggttcaagtctcagctctgcctcctcctccctggctctgagaccttggccaagttgcttctttctctgagcttcggttttctcttattaatggaacacggagtcccccgggagttgtcccaagggttccagggcgcagtacgtagaaagcttgggctggtcatttgtgctgctgtgcggataagctgaggctgcccagagtacatgctgcctgccacagggtgacattcagtctcgacgttgtctccggtccacacccctgttatcctgccctcttatgtgctgagcaatttctactgtgagtaggaatgtcagaacaggcagacctcagagatagtctgctcgaccatggtgatctcacagatgggctgactgagtccagagagggagagccccctgcccccactccccgccatggttctccagctggccatcccctgggtgtggcgccctgtgctgagttgagtggtctcatggt

SEQ ID NO: 92556 - DNA, 261 bp, Homo sapiens
tcatagtgccatgctatagctgcctgtttccaatgcttgatcaaactctcaccactgtctatgtgaaagtgtttaaaatttggctgtatgagtcttcatactaagacaaagaaaatcctaagtttttagactgaggaaatcaatttgagcaagtgtacattcacttttctttcatttgtattatgactttgtcttctgtcttatgttcatatttaacaatagtatttttgttgaatacatgtgttctgacttggataataa

SEQ ID NO: 92557 - DNA, 206 bp, Homo sapiens
gcctcaacttaattagtacctatatcattttaaagtttagtcagatccatttaagtattctgccttattaagtcattcataaatattttccatattattgtataatttatctaataatgtctagtagtatatgtataaatatatgtttatatactattatatattatttatactgtacaatctacactaataaaagaggtatatat

SEQ ID NO: 92558 - DNA, 368 bp, Homo sapiens
gttcacatatgattaatgtgtagtatgtgctttgttatcatggaaataataatgaaataatattgtgcaccttaataagataataagattcagagaatatgattaaatgctgagtttatctgagcacatagtttgaggatagccactggggaaacagatatcctgaagagtggggtcagtgctccaacacggggaatttgagtcttctcttctatagggcaaaatgaagcttaacagggtgacattttccatacaaggccggtgcacacatttcagtgatttgataggttgcagctaccaaatttcaaggatgattgctttaacttttttttttggatggagtcttgttcggtcgcccaggctggagt

SEQ ID NO: 92559 - DNA, 249 bp, Homo sapiens
aatactggattgagggttcatgatgactgttttattctagttgttgaacatgtacagccatgtcgaaggaaaagttctatttctcacctctcataaaggatggcattttaaaggtgaattttaatgtcattcatctaataaatatttgttgcatgcaataagcacaatgttattcatatattcatagtaaagtaatagggagaaaggaagtacggaatatcctgaggatatcagctgtcatcagagatg

SEQ ID NO: 92560 - DNA, 433 bp, Homo sapiens
atcttactgtcttgccccctgggtttggggggctcacagtgacattgtgggccctgccataatttctccacttcccttcttgtcttctcccccgtgtcctctccctcctgtccttcttctcttccctcttgccatctgtcttccaattctgctgcacaccgactcttgctgcggctgccagaggacagagtgaggatggagcagagccacgttctgtaggggagggggaggccccacaggtagtgtcaggtctgcggcaggtgtgagaagagagagaggatggcggggttcaatgctcgggcagctggcctgggtgggagtgtgagagatgcctggactgcttgccctgtcagtgcagccaagattatgttggcatctgtggagtcatgcaggactgccagtctctgggctgaaggttaaccaaccccctttg

SEQ ID NO: 92561 - DNA, 505 bp, Homo sapiens
  misc_feature (1)..(1): n is a, c, g, or t
  misc_feature (65)..(65): n is a, c, g, or t
  misc_feature (109)..(109): n is a, c, g, or t
ncactggggctggaacccttgggggggaggccagtaaaaggaaaggataggcttctgagatctcnggaacaaaaaatgtcaggcaaaaggcttaccttcccactcaaangctcttcttcaaactgtgtgtgcttttgctgtgatttgccttcacaatgcattcttcttgtcaagttctgtgcagctgttaactgaattattgtggtaactttggccataagtgatggtcttggctaacagttactcgtaataagaagagattacaggcatgagccatcgtgcctgaccaaaaactatgcttcctaaacagatttttacagggaggaatttgctacctgagaagacatagttccatccagtggtaactaatccaactctaatcatatgctccggaatgatcctatagttaagacattcaaagtcaaagttaataatagctctttccagctaattccagataaaaacaatcactttcaatacgaattagctccaatgctctctatta

SEQ ID NO: 92562 - DNA, 225 bp, Homo sapiens
ggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattct

SEQ ID NO: 92563 - DNA, 258 bp, Homo sapiens
actcaccctctctgtatacctctgagctccacatacaaaattggcaataataccacctattacacagaagggtttgaggattaaatgagatgaggagagcagagcttctctccaacagtactggaaactaagtattggctcctttctagtgtcctgggtgggtaaaaaggaagcatcttagaacttccacggtcccatttgtctctttctctgttgaaacttggcctttggcacataggagaagaaccaggtgaccct

SEQ ID NO: 92564 - DNA, 608 bp, Homo sapiens
tatctgtccccagtggaattaaggttgcaatctgtaatggaaagataatagggaaatcccaaatgtttggaacataagcagtaaccttatatgacatcacaatgaaatgatcaaaatacaaaaaaaaaaagatttaaaatcagtaaacagtaaatatcaaagctgaaaattatttttatagactattaaaactgataaatccttagtgataagttggtaaagacaaagataaaagcaaagtatgttacaaatacggaaatgaaaaatagcacatccctataaaacccatagccattaaaaagattacaagaggatgttatgtacaactttatggtcatatatttcaaaattttgatgaaatggacaaattataatccataactgttaatgaaagtaagtctttaaaaacctttttatgaagaaaatttcagtcccaggggttagggagggattacttaaataatacactaaatgtaccataagcaaaatgaataaattgtaatgtgttaagaatgagaacttctgttcattccaagacatccttgaaacagtgaaaaggcaagccacagactgaaaacatatttggtatacagctgataagggaatcc

SEQ ID NO: 92565 - DNA, 307 bp, Homo sapiens
acgtccctataacaatgtcacaatcttaaaataagactttctatcctttaattactaattttcacctggatatgctgtatgcatagcatttatttccataacgatggtcacttctttctccagagcaaaaaacaaacacaacaacaacaaaaacaaaaaaaacccaaaaaaactagaggttagaatattttccatatttagttcctcttgttatgtaacatggaatatttggaaagaattaagtcagctttgctgcagtaacaaccccaaatcttcatgtttataaggacaaaattttctcactaca

SEQ ID NO: 92566 - DNA, 257 bp, Homo sapiens
tgatacctacctgcaccaaatccattatcagtaatgggagagtctatctattatcttcgtaagggattctgagacttacttactctttacctttacgttaaatgtttctaaaagttttctttgggctttggcacagtgttaagagagtgcttgctattgattctttagcccctctcatccccaaatcttaccatgtcactcttctacataattctggctttccatgacccataaaccacatttctcaagtgtgctct

SEQ ID NO: 92567 - DNA, 532 bp, Homo sapiens
gctcacttaatcttttgttccttctacaaggaaaatcaaaataagagtattccatcatttttttgtatcagggaacaagcagggatagttatgcatttatccctgggcaataatgcccaaggtacaccagaggcaacaccaataacaaaaacagaaacgtggtgtgagtgtgaaaggaagtttgtgggtgcatttcattccagaaaacattgctgttaattttcctttgctacatttctgatatttcacctctgaaaacgcttttgtaagttctagacagtaagttagaaaaacatcagatggtaagacgtgtaataacattctaaatggagaataattctgcttacagagtacctaactgctcagagaaactgtcatagttatctctaggtcagatgtcagactcaacaagcttcttttttactaggatgaatctccaagaaagccttagagacccatttcttccaccaagattcaataaaataactcagcaccattcctaatgtgaatctaattgtgaaaaccagttttt

SEQ ID NO: 92568 - DNA, 356 bp, Homo sapiens
ttttcatgtgtgtggtgcctgtgtgtctgagtgcacattgtatggagggtctgggggctgcgtatgaggtaactgtgtgattctgtctgactctgggtgtgttttgtgttgggtgtgtctacgtgtgtgtctggcccacatatatgctggcccagggcaggatggaggggcctcctgtgtggtgctgctggactctgttgtggtcaccacggccccgtgggcttagcgtggggcactggtggggctgatgttgccacttaacctcagggtgggatggcatggagcaggcccatcccgatgtccctgggtggcctggtggaatgtgcccacgggatgcccaccactgggggacccca

SEQ ID NO: 92569 - DNA, 395 bp, Homo sapiens
aatctaggcagaatgttagaggcaagaggacgttgttttgaatggctcacttgagcctaagctgacttgaaattggccgcaaccagtgggagagaggctttggtgcaggacagggactggtgaatggtgaagtggtgaatggtgaagagcatattttggagggacagtagagcatgacagaagtgaaattgtcactgaactataattgcatatatagcccctgtggatattgtaggagcagaggatgtgggttgggtgttatagataggctggggaagagggaagtggttgactagttcggaagggtgatgggaagcatgaaatcagggcatgctatagacagaggagaaatagcttggtggtggtagattagtgattggaaataggagaattcg

SEQ ID NO: 92570 - DNA, 2380 bp, Homo sapiens
  misc_feature (1243)..(1243): n is a, c, g, or t
agcggggcggcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtcgagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcngaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagcgtgtccctagagcgcttcccaagtcaaaatataaacaccgctcgttcccgcctttctaccacatggcattccgctgggatacttctacggggaagcttcctgcccggggcatcgagggcgttcgcgtccgtctgttatggcggtgctgctgtagataaccggatccgcgaatgctaacgctcaccaggatgctatatagccttttttatattgcctatcaagcccggaatgtctgggtctagcgggtattgctaagtaggattgtgacagtcacgcccccggcagcggtgtttcaaagtcccctgacagctcagcatgttgtcacacttcaggactgtgccaatccgattgatgaagaaaatagataatcttgttttataaaacgtgcatgcgcagaatgttgagtgaatattttagtggactatgtacacgcacaaacacttcacaacgagtgagagagcctctgacttcacctgcagcttgccacaccaaggccccggggaggagtgaggcccaacttttatttattatatttttgtggttcttgcaatggagtctcgctctgtcccccaggctggagtgcagtggcaccatctctgctcactgcgacctccgcctcctgggttcaagcgattctcctgcctcagcctcccaagtagctgggattacaggcgtgcaccaccacgcctggctaatttttgtatttttagtagagacggggtttcaccatgtgggccaggctgatcttgaacccctacctcaggtgatccacccgtcttggcctccca

SEQ ID NO: 92571 - DNA, 911 bp, Homo sapiens
ctaacttgtgtgcaattgcaagaaagcatatgcgttcacccggagtcttccttccctctcttgctccgtgggagcacaccacactcactgttctgcacctctttgctttttccatttaacagcgtgtccctagagcgcttcccaagtcaaaatataaacaccgctcgttcccgcctttctaccacatggcattccgctgggatacttctacggggaagcttcctgcccggggcatcgagggcgttcgcgtccgtctgttatggcggtgctgctgtagataaccggatccgcgaatgctaacgctcaccaggatgctatatagccttttttatattgcctatcaagcccggaatgtctgggtctagcgggtattgctaagtaggattgtgacagtcacgcccccggcagcggtgtttcaaagtcccctgacagctcagcatgttgtcacacttcaggactgtgccaatccgattgatgaagaaaatagataatcttgttttataaaacgtgcatgcgcagaatgttgagtgaatattttagtggactatgtacacgcacaaacacttcacaacgagtgagagagcctctgacttcacctgcagcttgccacaccaaggccccggggaggagtgaggcccaacttttatttattatatttttgtggttcttgcaatggagtctcgctctgtcccccaggctggagtgcagtggcaccatctctgctcactgcgacctccgcctcctgggttcaagcgattctcctgcctcagcctcccaagtagctgggattacaggcgtgcaccaccacgcctggctaatttttgtatttttagtagagacggggtttcaccatgtgggccaggctgatcttgaacccctacctcaggtgatccacccgtcttggcctccca

SEQ ID NO: 92572 - DNA, 1980 bp, Homo sapiens
  misc_feature (1243)..(1243): n is a, c, g, or t
agcggggcggcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtcgagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcngaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggtaaaagcagtccccgcagctctcagtgttcgaccctccagtgagtgtccacgcacagggtgctggtgggtctactagactgcacctgcccgtctgctggatgagtgactgcagccagcttacatctgcaaacatcgggccctccccatggtggggccacagtagatactgacaggtggacagcccggattcctattccttccctggctagtgggtgacagaaggcctcgcagggttcaggtactctagtcgcttcatgaccgccaaggccagcttgctgcggggatgctcagcaagttccttagcctgcagggacctcttccggggaggactgaagtctttctaacaattctcacccccgtgggcagccggccttccgggtagctcctacatctctgcacctcgtggagtagggagtggaggggacgaagggggtgaaagctgctccctcttggccccagattcaggtctgtagtggtagcaccagaaaccaaagttactgcaacttaaa

SEQ ID NO: 92573 - DNA, 1686 bp, Homo sapiens
  misc_feature (1243)..(1243): n is a, c, g, or t
agcggggcggcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtcgagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcngaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggtaaaagcagtccccgcagctctcagtgttcgaccctccagtgagtgtccacgcacagggtgctggtgggtctactagactgcacctgcccgtctgctggatgagtgactgcagccagcttacatctgcaaacatcgggccctccccatggtggggccacagtagatactgacaggtggacagcccggattcctataatatctgtaagattatcctc

SEQ ID NO: 92574 - DNA, 1452 bp, Homo sapiens
  misc_feature (1243)..(1243): n is a, c, g, or t
agcggggcggcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtcgagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcngaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagactgagatggagaacttggcctgcatctcttctacatgcagactcgaccaggacatg

SEQ ID NO: 92575 - DNA, 991 bp, Homo sapiens
agcggggcggcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtcgagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattggtgagtagccctgacttctgttttgtgccagtgtcgcacggcccacggggtttgtcaccctatgtgaggaacttgggaatacattataaatacaaattgcaatccctgttagaaatgtcttagcaaggctgggtgcggtggctcacgcctgtaatcccagcactttgggaggcgaaggtgggtgggtcacctgaggtcaggagttcgagaccagcctggccaacgtggtgaaatcctgtctctactaaatatgcaaaaattaggcaggcgtggtggcgcacgcctgtaatcccagctactcaggaggctgaggtgggagaattgcttgaacccgagaggcggaggctgcagtgagccaagatcgcaccattgcactatagcctgggcaacagagtgagaccttgtctcaa

SEQ ID NO: 92576 - DNA, 3799 bp, Homo sapiens
  misc_feature (751)..(751): n is a, c, g, or t
aacgggacgctttctctgggatgcattgagtcagggaatagaagatggggtgaatgatgtttctgacccacagaccgttgggatgcttttgctgtcactttcccatcatgctgcatgaggcatgacagcagctgtgccattgatgccccagaatagaatcactgaggcttctctccagcagctcctcaatggtgtcgctgtctctccccgcagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcngaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagaggatgccagcatcaagccaaatccaccgacggcgagattgaggcctataagaaatccatcatgaaggaggaagaaaagaacgagaagctggcgagcatcctgaaccggacagagacggaagccacactgctgcagaagctcaccacccagtgcctgaccaagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccagaagaccctggtggagctggaccaggacgtgaagaaagtcaacgagctcatcaccaacagccagagcgagatctcccggcgcacgatcctgatcgagaggaagcaagggctcatcaacttcctcaacaagcagctggagcggatggtctccgagctggggggggaagaagtggggcccctggagcttgaaatcaaaaggctgagcaagctgatcgacgagcacgatggcaaggcggtccaggcccaggtgacctggctgcgcctgcagcaggagatggtcaaggtgacacaggagcaggaggagcagctggcctccctggacgcatccaagaaggagctccacatcatggagcagaagaaactacgagtagaaagcaagattgagcaggagaagaaggagcagaaggagatcgagcaccacatgaaggacctggacaacgacctgaagaagctcaacatgttgatgaataaaaaccggtgcagctcggaggagctggagcagaacaaccgggtgacagagaatgagttcgtgcgctcgctgaaggcctctgagagggagaccatcaagatgcaggacaagctgaaccagctcagcgaggagaaggcgaccctcctgaatcaactggtggaagcagaacaccagattatgctttgggagaaaaaaatccaactggcaaaagagatgcgttcctcagtggattccgagatcggccagacggagatccgggccatgaagggcgagatccacaggatgaaggtcaggctcgggcagctgctgaagcagcaggagaagatgatccgtgccatggagttggcggttgcccgcagagagaccgtcaccacccaggccgaggggcagcgcaagatggacaggaaggcgctcacccgcaccgacttccaccacaagcagcttgagctgcgccggaaaatcagggacgttcgcaaggccaccgacgagtgcaccaaaaccgtcctggaactggaagaaacacaaagaaatgtgagcagctccctcctagagaagcaggaaaagctgtcggtgattcaggcagacttcgacacactcgaggccgacctcacccggcttggggccctcaaacgacagaacctttcagagatcgtggccctgcagacacgccttaagcacctgcaggctgtgaaggaggggcgctacgtgttcctgttccgctccaagcagtccctagtgctggagcgccagcgcctggacaagcgactggctctcatcgccaccatcctggaccgcgtgcgggacgagtacccccagttccaggaggccctgcacaaggtcagccagatgatcgccaacaagctcgagtcaccagggccctcctagggagcagcctggaccccgccttgcaaggcctccaggaagagatccggaattgtgtttgtcatgagggacttggaatcttttgtgttcctaaaaaccacatgtaccctcagaagggcatcgtttaagagaaataagccagccccacccacaggaatctttttagccactcagcaatttaataaaccaggtaaaatcctagcgtttcccatggcatcccatcgcaaagacagagcctgtgactgcagacccacacacccacactcccacactgggcttactcgtccaggtaacactttggtttgcagcactcccaaatctgcacgtgcctctcacaacacaacgctgccacaggtccacaagctggtgggctgagcagaggtgggaaagttaaggcagctccagccagcctggcccgggaggctggtccccccagcacttccctctactaggtgcatctgaaaacccacaaaccaccttctttaccagttttcccatccccaccccttagaactctcaggtcccttttcctgcccccatgtccccatttgagttaaattcagatccacagcttgcaggagaaagtcagtggccccagacacacgtaacagggtgagcactgaaataagagcacgctggggcgtccacaccaagggactacgccccagtctgcccacctatcttttctccatcattaacccagcgctctttctccctggacttccaagtaccaatgaccttggggcttctttgcagtttaaagggaaaatgctctacaaaataatttcactttcaaacatttcagcagaagaataaaatcttttttctgaatatct

SEQ ID NO: 92577 - DNA, 417 bp, Homo sapiens
ttgagtctgacaactttcacaaatgtaatgagttaaaattgaataacttctcagtggcaattaagccctgttgacttagttttggttgttcttgccatagacaggatccacagaggagccccaggggcaggtgctcccaatgggcgtccagcaccgcttccggctgagccacgggagcgacatcgagtcctcagacctggaggagttcgtctcgcaggagccaggtgccacccacctgctgaggtcaccctgccctggcgatgagccacctgcacaggcccttctgtgcaagggatgccactcgtttgtcatccgttacctgtttcctgagtggctgtgagccaaaaatggcaggaagggtgcccagaacggctgttccctgcttcctcctgggtctctgcatgggggacgctggga

SEQ ID NO: 92578 - DNA, 2052 bp, Homo sapiens
  misc_feature (1243)..(1243): n is a, c, g, or t
agcggggcggcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtcgagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcngaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcaggtactgcagggccacaggcagcgaggatgtgcgggaaccccaggggtccgtggcaggcccgccccacaccccctctctctgggtccaccggatctctgggacagagggtgcaccttgatccccgggtccgggcttccgtccggaaagctccctcattgtttggtaagatttcagcgattcttaaatcctttccaacactgcggcgctgggaggagagaggcttttctgctcagatttcctggcaggattaagtagaaacagagcagggtaaagagaaagctatctttgggaggtaaaggtgtccctttgatttgcagtatcaccacctgagtgcggaaaccccatcccttctcgattgttctgcctgagggctgcattccaaccgaaatcctattttaatctccaaaggaaggggaggaagaggcctcctctgggcatcccctcacttctggggatggatg

SEQ ID NO: 92579 - DNA, 2900 bp, Homo sapiens
  misc_feature (1243)..(1243): n is a, c, g, or t
agcggggcggcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtcgagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcngaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagaggatgccagcatcaagccaaatccaccgacggcgagattgaggcctataagaaatccatcatgaaggaggaagaaaagaacgagaagctggcgagcatcctgaaccggacagagacggaagccacactgctgcagaagctcaccacccagtgcctgaccaagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccagaagaccctggtggagctggaccaggacgtgaagaaagtcaacgagctcatcaccaacagccagagcgagatctcccggcgcacgatcctgatcgagaggaagcaagggctcatcaacttcctcaacaagcagctggagcggatggtctccgagctggggggggaagaagtggggcccctggagcttgaaatcaaaaggctgagcaagctgatcgacgagcacgatggcaaggcggtccaggcccaggtgacctggctgcgcctgcagcaggagatggtcaaggtgacacaggagcaggaggagcagctggcctccctggacgcatccaagaaggagctccacatcatggagcagaagaaactacgagtagaaagcaagattgagcaggagaagaaggagcagaaggagatcgagcaccacatgaaggacctggacaacgacctgaagaagctcaacatgttgatgaataaaaaccggtgcagctcggaggagctggagcagaacaaccgggtgacagagaatgagttcgtgcgctcgctgaaggtccggccgtgtccacgcagtcccggggctcaggacgatggagggcgggggcctctgagagggagaccatcaagatgcaggacaagctgaaccagctcagcgaggagaaggcgaccctcctgaatcaactggtggaagcagagtgagtcccagtctccagccacacgtgggtcatgaaggtcactgcacctacaggcctctgtccgttgaagaccatgtaggaggccaggtgtggcagctcacacccatatc

SEQ ID NO: 92580 - DNA, 244 bp, Homo sapiens
attcggaacgagggggaaagccgcccgtcgcctgctctgtgccttaacttattctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92581 - DNA, 1113 bp, Homo sapiens
tttaaccttttatagagatggggatcttggtatgttgcccaggctggcttcaaactcctggcctcaagcgatcttcctgccttggctccctgaagcactgggattacaggcatgagccaccacacctggcccaccctttttgaagtagtctgggcaatgcacaaagcagtccatggtggccccccagtcccccaggcttactaccccccttgttgcagagcccaaagtccagctcctcattcccccatcactcttctaactggggacccaggactcctgcactgccctgttcttaccccctatatcccaatcacctgtactgttagctttcaggttcttattggttcctccactaaggacgggccatgagggcagggaccttatctgcccttcagggggaattcccagtaccaggcacgcagtaggtgttccataaatgtttgctgaatgactaaaagcccaccccaaggaacaaagaaaaatctctcctttcacacacttcccagggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92582 - DNA, 578 bp, Homo sapiens
acaatatttcttcacctacttttaagggaggcatctaggttttataaataccagctcttggcacaagaggcttagggtttgtacccccgccctcaccactgctcctgcccccacccccgcggctccgtctgtgtgcagtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92583 - DNA, 210 bp, Homo sapiens
gcggccgcctactactactactgctcgaattcaagcttctaacgatgtacggggacatggtccagtgagctgccagggcatcaccggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92584 - DNA, 169 bp, Homo sapiens
gcggccgcctactactactactgctcgaattcaagcttctaaccggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92585 - DNA, 920 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagctcccagtggtccttcagcaccatcagcagcagcacccagcgctcctacaacacctgctgcagctggacccaacaccctttgatccagaagaaccgccgagtggtgctggcctccttcctgctcctgctgctggggctggtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92586 - DNA, 1087 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagctcccagtggtccttcagcaccatcagcagcagcacccagcgctcctacaacacctgctgcagctggacccaacaccctttgatccagaagaaccgccgagtggtgctggcctccttcctgctcctgctgctggggctggggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92587 - DNA, 902 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctgggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92588 - DNA, 1419 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgagcgaccctcccgcccccacaggcagaggacacccctgtcttgtgtccacgggtccacggcaagccctcccacctcccggcagtacacggctccttttcagctgggagtgaggcttgcccgggcagtcagcggcagcccggaaggcctcgaagcctccgccccctcgccctgaccgggctctggtccctcccgcaggtgtctccagcgccatcttcttcgtgccgggcttcctgttgttggtgcctggaggtgcgagcgggcaccggggcggaaggggcgggggctgtggggcggcactgggggcggtgttgcggggaggggcggggcttctgcgctgacaggccccgccccgcagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92589 - DNA, 1692 bp, Homo sapiens
  misc_feature (1421)..(1421): n is a, c, g, or t
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgagcgaccctcccgcccccacaggcagaggacacccctgtcttgtgtccacgggtccacggcaagccctcccacctcccggcagtacacggctccttttcagctgggagtgaggcttgcccgggcagtcagcggcagcccggaaggcctcgaagcctccgccccctcgccctgaccgggctctggtccctcccgcaggtgtctccagcgccatcttcttcgtgccgggcttcctgttgttggtgcctggaggtgcgagcgggcaccggggcggaaggggcgggggctgtggggcggcactgggggcggtgttgcggggaggggcggggcttctgcgctgacaggccccgccccgcagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccacaanaaaaaaaacaaaaaaaaacacacacacaaacaacaacaagaaaaaccacaaacataaaacaagaaggaaaaaaaaatataaaaaaaaccaaaggaaaaagagttccaagagccaaatattgcaccagggagacataagggagaccactaagaggagcacataaatgggaaacgcggggacctagaaaaggaaaacaaaacaaaagaaaacaatcaagacaaggaaaacaaaaagaaaaagatagggagaaaaaatagcaacaacataacta

SEQ ID NO: 92590 - DNA, 947 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92591 - DNA, 1114 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92592 - DNA, 1261 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctgggtgagtggccctgagggttggggtcaagaggggccccgtgggaggctctgccctccttttgtacaggctctgcctcccccttgacactgagcctcccagcatcctgaggaggcagctggctgccatcatcacactcccattttacagggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92593 - DNA, 1912 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctgggtgagtggccctgagggttggggtcaagaggggccccgtgggaggctctgccctccttttgtacaggctctgcctcccccttgacactgagcctcccagcatcctgaggaggcagctggctgccatcatcacactcccattttacaggtgaggagacagaggccttgtgacctgggcacacagccaggaaatcacacatagctgaaaatggaacctggcttatcactgcaaagacttttccttttttaaaaaatttaacctgtttaaatccattagaggacagaagagtagcagctaccatttattctgtgtctactctgggcaaggtgcagggcagttttattttcccatcttacagaagtcctacaagtgaggtggtgcccagaagccacgtgtaggggctcagggatgccgagtgcccagccagtgcagagccgcagggcacctggcacttccccttgtctggcatctaagcactgacaagcacccctctcctacccattgctcagatgggggaacttttggtccagagcaggcagatctcacaccaggtgttctttggctcccaggcacctcgttctttggggtagaggaggcagagtccccagaaaggatccagggttggggtcacgagtgatccataagaagggactaactgtggctgctaccctggctcatctctccgcttctccaggaaggccaaggctccccagccagccaggcccctggcacagagtctggcctctgctcagggtgtttgagtgtgggggagggggctgccacttcccagcaccgctgtacactggccctggtagtgctgccaagttctttcatttttcccctcaacccagcaaggcaagcctggggctaccagagcgccttagagggcctttgtagggtgcagggagtgagtttcagcccccatcataccctatacccctttatttttatttatttattttttgaggaggagtcttgctctgtcgcccaggcaggagtgtagtggcgcaatctcggctcactgcaacctctgcctcctgggttcaagggattttcatgccttagcctccagagtagctgggattacaggcgcgcgccaccacacctggctaattttttgtatttttttagtagagatggggtttcaccatgttggcctcaggtgatccacccacctcagcttcccaaagtgttgggattacaggcgtgagccaccacgcccagccctttttattttttagagacagggtcttgttctgttgcccaagctggagagctgtggtatgatcactgcagcctcaaactcttggactcaagccatcctcccagctgagcctccctagtagctgggactacaggcatgtaccaccatgctcagctaatttttttttttttaaaataataa

SEQ ID NO: 92594 - DNA, 912 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggtgctgatcctggtcggcgtgggactggaggcgaccccctctccaggtgtctccagcgccatcttcttcgtgccgggcttcctgttgttggtgcctggagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92595 - DNA, 639 bp, Homo sapiens
aaaaaaaaaaaaaaaaaaacaatgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaca

SEQ ID NO: 92596 - DNA, 488 bp, Homo sapiens
ccttcttcacatcaaaggagatgtctgtctcccactgggacctcctcagtggggagctcccagtgtagtgccatctgggccagggggtttttaacttggaagggaagcaaggctggatgatgagtgcgcagctgtaccacctcatagtagttatctgtagggacaaagagctcctcagggtctgggaatgtggggaaaaagatttgttgcttcccagtggctctattaccacccaggagcatgaggtctttcttggggacctgaaacctcactatctcttcccatccccattctctatgctccttcctgtctcataaggaaggggtcctggactgaggatgctgaagacaaacttcctagttccagatctgtcattagcttgctgtgtgtattaaagaaatctttccctctctgcacatgcaatcatgcacaatgcaaggattcagactgcttgatctttaagggcccttcaatgtaaaaaatgcaaa

SEQ ID NO: 92597 - DNA, 369 bp, Homo sapiens
tcctgccttagcctcccaagtaactgagtctacagcacacaccaccacacctaatttttgtagagatggggttttactatgttgcccaggctggtctcggactcctgagctcaagcaatctgcctgccttggcctcccaaaatgttagaattacaagcatgagccaccatgcctggcccctccaaagactaggtattgaggaagaacttaaaaggcattggtaatccatttcctagttctgggccctcactctcgaggtgaatttcctccatagcatatttacaccaagttgtgctttcctgtgtacaggttgctgttggcccaggatgtgcctctgtgcaaactggaaaaggcgccttcctcaagtaa

SEQ ID NO: 92598 - DNA, 492 bp, Homo sapiens
agatgtcagatgtcatacttctgttaagaatttaaattatttttagtctcaggctgtctacatgtgtacatctgtgtgaccttgcttggtaatgagagtcacagaaaaccgcctttcagaaaacacacagtcacacactggtgactctctgtgccctcttccattcctcagaaccccctcaaagtgtgcatgtcaattgcttcccagtactctggagatgcttttttgtcggaggtccacagactaatggcagcaactcatccttctagggggtatcacaaacacgttatcaggttcctaagataactctctcctgacttctatgctccttgagcaaggtagggaggagggtggcatccagagtcagtcagtgcttggtttgcatcacagttctgttttgattgtttacttgccaggtgacaatggcaaggctattgaatttcttgaaacctccattttctcatctgtaaaacaagggcaagaatgctactt

SEQ ID NO: 92599 - DNA, 429 bp, Homo sapiens
gaaggtatcgggtacccaatatgcttgtctacccttcattggtgccactaattatctcttttatctgctttaaaatggaacggtaacttcctaaaggcccttctcaatttaaggtctatgactgctaaacataatgaatgataactataaatgccccctaagatcacttacccaaggtcacacaaaactgggaagtgaacacagatctgcttgatgtataaatcatatgctcttttggtgccttactatgttacttaaacctctttgacactcatttataaaatttcctcatatataagatatggataacatacagctgagaattaaagaaaatataataaaagcctgacataaaataagtactcaataaatggtaaccattagcagtcacagtttcatttaattcgcatacttctataattctcgaca

SEQ ID NO: 92600 - DNA, 541 bp, Homo sapiens
cggctcacacctataatcccagcactttgggaggttgaggcaggaaaaagacttgagcccaggagttcgaggctgtagtgagttctgatcatgccactgcacttcagcctgagagacagagcgagaccctgtctccaaaaaaatttgaaaacagatttttaaaaactgttttggaacctcctcatacttgcacaaaaaaattcctcttgtacaaaggcttttctctagatttaatgttgactcttttatctttcttcataagatctacttttaatcctttgttcttttttgaaaagacagtatttcttttctatttgcatccagccatttttttatcctatatttgtgaatttgcaaaataaaatataagttgtttaattctgcccttcttttcttcagacagggtcttgctctgttgcctaggatggagtgcagtggtgccatcaaagttcactgcagcctcgaccccctgggctcaagtaatcctctcacctccacctcccaagtagctgggactacagatgcacgccatcacacctgg

SEQ ID NO: 92601 - DNA, 233 bp, Homo sapiens
ttgtcaggctgggtaagttccagaaccttctggagccaggattctctttcccagccctgggccctgagctcggcggatgggatctgcgaggctcggggcgcaggggaaatgggggcgtgttcctttaaggcggaaccaggcggggagtgggacgtcccccgcgggcacagcccgagccgcacctggggcccaattagcctggagcgcggccgggtgtgttgaacgtagcaacc

SEQ ID NO: 92602 - DNA, 410 bp, Homo sapiens
aaggaatttacatagttgaacaactattctttggacatcttttagtccagtagacggtgttaaacttgaagacaaataacgatttgacctgtgatatttgtttttccctcttatcctctaagcccattcatccagatcattcatcacctttaaaggcatccccagagggaggcaggtctggacagagctgaagattgcacaggccatttgcaggctggattcgttctgtggtgacccacctgtctgactcgagttatttttttcccatgtctggacaagactgacctctgcccagcaactcaggcctggatttagtccaagggccctcagtggctttttttgtttgtttgtttttttcaggaagtgaagaatttagagggataaaaggcggaaataacttttcagcctct

SEQ ID NO: 92603 - DNA, 192 bp, Homo sapiens
aaggaatttacatagttgaacaactattctttggacatcttttagtccagtagacggtgttaaacttgaagacaaataacgatttgacctgtgatatttgtttttccctcttatcctctaagcccattcatccagatcatgccactgcactccagcctgggtgatagagtgagtctcttctccaaaaacaaa

SEQ ID NO: 92604 - DNA, 304 bp, Homo sapiens
acatttggagatatacaggttttcccttacatgcatgcaaaacactaggccactgactcctaatagggatttttaagttcgaaattacaaaatgtaccaaatcacaccaaggaactaaatggagccttgttcttagaaaaagttaacttcagtagatctactttaaaaacatttaaattggaagaatattttttggaaaatgcttgacttgtactgatctaaaagctcttctccaaattcatcatgaatatctggtccaaagaatcggaaaacctttagtggtccccataaaacctgtaattcc

SEQ ID NO: 92605 - DNA, 393 bp, Homo sapiens
ccggatggacctctgactgggaacacgctaggctgctgcatcactctcaccagtggcagccagccttgccttaaaatttaaaaatcaggttctgaagtccatctctgccttctcttacctgactttttagcttctcaacctttccaaaaggcaggctgaggaacgtggtattggcaaagcaaaagcattctggggccggaagattggacctttatatcctgcatttctcagggttccaatggcagagcattccatgtcacctcctccaagagccctccctgactacccacagggcttagtgcttcctcgactacagagcttcatggatgctctgcccattcctttgttaggcagtgcagtcagcagcgtgccgcaattgcgcatttgcctgtc

SEQ ID NO: 92606 - DNA, 424 bp, Homo sapiens
ctcccagctgcttgggaggctgaggtaggaggattgcctgagcccaggagttagaggttgcaggagttagaggttccacgatcgcacctttcattccgttacatttgctgccttgagaacagaagacctgctggttttgttgccagtttgctcagtcatttttatgaaaaagccagtgctaactaggtgcttcttcgtgccttctctgagaatcaagaactctagtatgtttgcgtgtgttcagtctctcattaaatgttctcactatcccagagaaccatctcattggaccttggtctgtacataccttcatctttggctctgacttgtaattatttttagaacttctctttttttttttttggagacagagttttgctctagttgccagactggaatgcagtggcacgatctcagctcacct

SEQ ID NO: 92607 - DNA, 414 bp, Homo sapiens
taaaaacccacaatggcatgctgatattgacatggtttttgtgtcaaaactctgtaaccctacttgcttggcaacctggcccatacctgcctttccgactgtctcatgccacccccaccaaacaccttgcaccctagccatgccagatcacgtgacctttgtgcatgctggtcctactgtcttcctgcctttgttcatgtcctgctggctttgtgtggaatgctccccattcttttcctcctgaaattctgttcatccttgaagtctcaccattgcctccttgggaagctatctctaatcccatgcagaattcaatttacctttgtctgtgctgacatatcagtggggtaactaaaatactacctgctgttattcagcctcccttattaagcatacactgtgagcgggaaacta

SEQ ID NO: 92608 - DNA, 3265 bp, Homo sapiens
caacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaaacagttggaataagaaagtaaactagtctagttttatacgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatcaattaaataaatattttagtggaaaaaaaaaaaat

SEQ ID NO: 92609 - DNA, 2248 bp, Homo sapiens
agcagtagtcaagagttttattctttgttctattaattgcacagagaaaaaacactttgacaaacactaaaagtaatatatagaaatcttcactttgacaaggtataacaaagattttatcacttgctttcctctgggagtttcttatatcccaattacaaaaacttaagaaaaaatatgtgtctagttcgtattactacaaatataatcgctgatggcttggggtttctttctgactgtgctcatttgggaaaccttgcagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaaacagttggaataagaaagtaaactagtctagttttatacgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatcaattaaataaatattttagtggaaaaaaaaaaaat

SEQ ID NO: 92610 - DNA, 1526 bp, Homo sapiens
caacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaaggttttttgaggaacaggcgttattttgttttcatgacatcaccccattctcccacccctggtccctgacaactgccattctacagttgagagatttggtgatttgtgagttgttttttatttactttaaaaattttttgatttgttttttatcatctttttcaatttagagatgttttgcacaagtaaaaattatggggcttattcagtaatacatgtctgtaaggaataaacattaagaaacccaa

SEQ ID NO: 92611 - DNA, 521 bp, Homo sapiens
gctgtggtcagaactctgatgaaaatacagcttagagatccaggggccaaagcactcgttttctcaacggtataatcaacattttcatcctcaatattaattcgaactgattttccctctctaatcagtttacagctgagaactaatttttgatgtttactcttagattttttttcccaaatccataagatagaattatttttagagaagatagaattatttttagagaaatgtgatgatgtttcacaaggcaatttgtatagctatatttcatgactttttattagtttcatttaaggattttcttagtttaatatttttaaaattggaatttctgactttgaaagtctcatttcacaaaaatttgggttgaaaaagacaatctactttataaagtgttgagtaaaacccttagttttcattttcgaaaactaagtaactatattccagtatgcactccattatgtattttctactgtttgtttatcttaattacattttcaaaaccagcatttgatgca

SEQ ID NO: 92612 - DNA, 1760 bp, Homo sapiens
caacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaaggtaggtaataatttaccacaagtagaagggggaaggttttcctgttaaaagtttgtatctttagaacttcttcacttagatgacaacgaaaaatatagcacaaatacgtttttaaaagcaaagtctgacgttttgccttttcactgtttcccagtcagtgctccagactttgtatatttgaattaatttattaattgtaacatgtaaatataaactatcctacattcctttgccacattggatcactttctgaggctgggagttcgaaaccagcctggccaacatggtgaaaccccatctctactaaaaacacaaaaattagccaggcatggtgacacgcaccatagtcttagctagtcgggaggctgaagcaggagaatcgcttgaaccccggaggtggaggttgcagtgagccaagatcgtgccactgcactccagcctgggcaacagaacgagtctgtgtcaaaaaaaaaaaaaaaaa

SEQ ID NO: 92613 - DNA, 999 bp, Homo sapiens
  misc_feature (3)..(3): n is a, c, g, or t
tanaaaaagcaggctgtaccggtccgaatccccggatcagcaagcccaggcggcggttggaaaggctggaggacacacctaaacatgtggaatcccaatgccgccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92614 - DNA, 1185 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92615 - DNA, 811 bp, Homo sapiens
gggtagggacccaacgggaaggcatctgaatacccaccgccagccccggaaaaggcaccagtaaaacccgtaactgaccagcggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92616 - DNA, 1387 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
  misc_feature (1235)..(1235): n is a, c, g, or t
  misc_feature (1238)..(1238): n is a, c, g, or t
  misc_feature (1329)..(1329): n is a, c, g, or t
  misc_feature (1333)..(1333): n is a, c, g, or t
  misc_feature (1339)..(1339): n is a, c, g, or t
  misc_feature (1344)..(1344): n is a, c, g, or t
  misc_feature (1356)..(1356): n is a, c, g, or t
  misc_feature (1358)..(1358): n is a, c, g, or t
  misc_feature (1360)..(1360): n is a, c, g, or t
  misc_feature (1362)..(1362): n is a, c, g, or t
  misc_feature (1364)..(1364): n is a, c, g, or t
  misc_feature (1366)..(1366): n is a, c, g, or t
  misc_feature (1368)..(1369): n is a, c, g, or t
  misc_feature (1371)..(1371): n is a, c, g, or t
  misc_feature (1382)..(1382): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctcacaaaaaaaaacaaaaaaaaaaaaaaaaaaaaaaaaaaaaaaaaaaaaaanaanataaaaaaaaaaaaaaaagcgcgcgcgacgcacgcgcacacgcgcacacagcaagcgcgcgcgcgcgcgcgcgcgcgcacacacacacacncacnctctcnctctntttttttttttntntntntntntnntntttttttttcncccac

SEQ ID NO: 92617 - DNA, 1731 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
  misc_feature (1418)..(1418): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctcacaaaaaaaaacaaaaaaaaaaaaaaaaaaaaaaaaaaaaaaccgcgggggctttttttgggggggggaaaaaaagggtttttaaaggggcaggggcaaggttttccggagacccctttttttttcaacaggggggaaaaatggggggcccccaaaaggggggggagcaatcaaaattttgaggataacccgcgggtttaactctcgttttgataattcgtcgcggaaaaacantggacagaacagagagcagagagcagacagagagaccgcagacgagaaccgacaggaacggaagacacagagaaacgaagagccaccacgaccgagcgagataggacacaaacgaacggagaaagacccagaaccgaaaagaaaccaaggtggaggcaaacaagcaaaacgctgagccaaccaacagcagcggcagacgagcacagctaactactggactaacgacaaagaagacactgtaatgagacagaacccaagagaacgagtagagagagaacatacaggcgaccgagcaacgaacatggagacaaca

SEQ ID NO: 92618 - DNA, 1624 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctcatctcagctcacctgtgctatcaccttggctgggcatggcacattctactacttttgctaaccttccacagaccctttaaagtgtatcagtttcatagaagggaaccagagcatcagtgagaaagacactgtatgattcccatgttttttaagtgggaggactcttcaaaattggctcaggcagagtggcatgaatctttattgtcttcccttgggtgaatggatataggcctttagcttatatgttttcatatctgctacagagattcttaaccctggctgcccatcagctgtgagagagtaatttggggctttgccccaaatctactgaataatacttatttttatttttttttaaattttttcctaaaactttttatttttatttatgtatttacttattttgagatggagtttcgctcttattgcccaggttggag

SEQ ID NO: 92619 - DNA, 1178 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtctgtactacgctttggagggatcctctaggtca

SEQ ID NO: 92620 - DNA, 1090 bp, Homo sapiens
caatcagatatgtctagtacgagcctggtgttaggcggtgaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92621 - DNA, 1159 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccgtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92622 - DNA, 1298 bp, Homo sapiens
gtcaacttagtgtacaatgctgtcagatgaaccttacccttgtaaggcttgtaacttggttcctccctttcttaagcccttatggctatctttcttcttttaatatttaaagtttttaatctttaaatttttaatttttaaaccatgcttgtttaacctgctggtaaaattcacgtctttcagactgtaatgctttcatgccaagtaaatggtcttgccaggcttccagcctgtttcagagaccactagcccagagccgtatcagccccttcagcaagccataagaaatttctactcctcctggaaatagatgtagagactatgtccatgcttagcaggaagtagttccagaagagacctttgctccttaagaataaggagaatgaggactgcgaaggagaacgcagcaagcccaggcggcggtggaaaggctggaggacacacctaaacatgtggaatcccaatgccgagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92623 - DNA, 1164 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92624 - DNA, 1055 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccaagtatgccaacattactataaagatttg

SEQ ID NO: 92625 - DNA, 1058 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92626 - DNA, 1198 bp, Homo sapiens
gtcaacttagtgtacaatgctgtcagatgaaccttacccttgtaaggcttgtaacttggttcctccctttcttaagcccttatggctatctttcttcttttaatatttaaagtttttaatctttaaatttttaatttttaaaccatgcttgtttaacctgctggtaaaattcacgtctttcagactgtaatgctttcatgccaagtaaatggtcttgccaggcttccagcctgtttcagagaccactagcccagagccgtatcagccccttcagcaagccataagaaatttctactcctcctggaaatagatgtagagactatgtccatgcttagcaggaagtagttccagaagagacctttgctccttaagaataaggagaatgaggactgcgaaggagaacgcagcaagcccaggcggcggtggaaaggctggaggacacacctaaacatgtggaatcccaatgccgggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92627 - DNA, 887 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttga

SEQ ID NO: 92628 - DNA, 1236 bp, Homo sapiens
aaaagcgggagaaattaccctggagagactgaaaaatgtttttatttaataactagcattgctgggagtatatgcttaaggaaccttgaatagaactcccagccttttcttacaccttccccactttttcccattgtgcttgggaaaaagtagagatacatgcacatacaactgctgtttctactgtcttttcttagatttgtagaatccaatttcttaaaatcataggactttgcacgcagctaatgaataagcattgaaaaggtaacagctgtttcctagcactatactatgcttgtgcctgtaatttattccttgcctaggcatcgattcaggtaaagaaagttggaaatttgctccaaaggcaatatgttaaattttttaaattccgtgtgataatttaggatggtttaatccattcctgtatgctcactgctgaaggaaacccttgcttttgtttaggtacagtctgttcaagactcctgaccttcttagggaagcaagggatacttgggtggaggggtggggcaccaaagaatggcccacggagtgattgaaaggtcatttggatctgatgctatcttctttcccctttcccctttccccttgcagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92629 - DNA, 955 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgaggatgtgatgggttataaacactggactcagagagatgtgataagtggagaggtaaatggtattccag

SEQ ID NO: 92630 - DNA, 1069 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
  misc_feature (917)..(917): n is a, c, g, or t
  misc_feature (920)..(920): n is a, c, g, or t
  misc_feature (1011)..(1011): n is a, c, g, or t
  misc_feature (1015)..(1015): n is a, c, g, or t
  misc_feature (1021)..(1021): n is a, c, g, or t
  misc_feature (1026)..(1026): n is a, c, g, or t
  misc_feature (1038)..(1038): n is a, c, g, or t
  misc_feature (1040)..(1040): n is a, c, g, or t
  misc_feature (1042)..(1042): n is a, c, g, or t
  misc_feature (1044)..(1044): n is a, c, g, or t
  misc_feature (1046)..(1046): n is a, c, g, or t
  misc_feature (1048)..(1048): n is a, c, g, or t
  misc_feature (1050)..(1051): n is a, c, g, or t
  misc_feature (1053)..(1053): n is a, c, g, or t
  misc_feature (1064)..(1064): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgaaaaaaaaaaaaaaaaaaaaaaaaaaaaaanaanataaaaaaaaaaaaaaaagcgcgcgcgacgcacgcgcacacgcgcacacagcaagcgcgcgcgcgcgcgcgcgcgcgcacacacacacacncacnctctcnctctntttttttttttntntntntntntnntntttttttttcncccac

SEQ ID NO: 92631 - DNA, 214 bp, Homo sapiens
gtcaagagtctcttcgcagcttggggctaggatcttcatttgccttttttcttttttggaggaagggggctgtgtccacatatttaagtatttgaggttcttgggcaacttccttcttacttcgcctcgaggcgtatcctttttttagcctgaggtggggtcctccccagggagagagaaagttgtttgagatcctttcttactctgtgcgtgg

SEQ ID NO: 92632 - DNA, 1476 bp, Homo sapiens
gtcaacttagtgtacaatgctgtcagatgaaccttacccttgtaaggcttgtaacttggttcctccctttcttaagcccttatggctatctttcttcttttaatatttaaagtttttaatctttaaatttttaatttttaaaccatgcttgtttaacctgctggtaaaattcacgtctttcagactgtaatgctttcatgccaagtaaatggtcttgccaggcttccagcctgtttcagagaccactagcccagagccgtatcagccccttcagcaagccataagaaatttctactcctcctggaaatagatgtagagactatgtccatgcttagcaggaagtagttccagaagagacctttgctccttaagaataaggagaatgaggactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92633 - DNA, 1220 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctcaaaataaaaaatacatatcgggtacgagctgcgagt

SEQ ID NO: 92634 - DNA, 1151 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
  misc_feature (1151)..(1151): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaacctaacactcatcccccccacccccccccccccccccn

SEQ ID NO: 92635 - DNA, 1520 bp, Homo sapiens
gtcaacttagtgtacaatgctgtcagatgaaccttacccttgtaaggcttgtaacttggttcctccctttcttaagcccttatggctatctttcttcttttaatatttaaagtttttaatctttaaatttttaatttttaaaccatgcttgtttaacctgctggtaaaattcacgtctttcagactgtaatgctttcatgccaagtaaatggtcttgccaggcttccagcctgtttcagagaccactagcccagagccgtatcagccccttcagcaagccataagaaatttctactcctcctggaaatagatgtagagactatgtccatgcttagcaggaagtagttccagaagagacctttgctccttaagaataaggagaatgaggactgcgaaggagaacgcagcaagcccaggcggcggtggaaagtggggtatctggattccataggtttttccttttccccttgctaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92636 - DNA, 1131 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(8): n is a, c, g, or t
ngncnanncatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcacccttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92637 - DNA, 789 bp, Homo sapiens
gaatggctcgctttgctctatggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 92638 - DNA, 1067 bp, Homo sapiens
gtcaacttagtgtacaatgctgtcagatgaaccttacccttgtaaggcttgtaacttggttcctccctttcttaagcccttatggctatctttcttcttttaatatttaaagtttttaatctttaaatttttaatttttaaaccatgcttgtttaacctgctggtaaaattcacgtctttcagactgtaatgctttcatgccaagtaaatggtcttgccaggcttccagcctgtttcagagaccactagcccagagccgtatcagccccttcagcaagccataagaaatttctactcctcctggaaatagatgtagagactatgtccatgcttagcaggaagtagttccagaagagacctttgctccttaagaataaggagaatgaggactgcgaaggagaacgcagcaagcccaggcggcggtggaaaggctggaggacacacctaaacatgtggaatcccaatgccgccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttga

SEQ ID NO: 92639 - DNA, 380 bp, Homo sapiens
aaagtagcaaaggatgagtctgcagagattgacagggttcagctcacatcatagaaaaatattagacttctttatgacaatgattgagtcattgaggactttaaacaaggatagtgaaataattggatttttactttggaaatatcactctagtaaaagacagagaactagacagtaagcattttgcatctcacgatatatatactctctggcacaactattaaactgcttttgcagcagtgcaaaagcaaatataagcactatgtagtggatgggcatggctgaatttaaatttacagaaacagacaacaggtagtgtttaggccttagtttgccaacccctgatataaaatacacaagggaaagccaaacatagagaa

SEQ ID NO: 92640 - DNA, 407 bp, Homo sapiens
gaagaataaaatacaagctgtctagttcttaatatggtaaaactctctatcctcttacactctgctttcttatttatttatttatttatttatttatttatttatttatttattttgagatggagtctcgctctgtcgcccaggctggagtgcagtggcgcaatctcagctcactgaatgctccgcctcccgggttctcgccattcttctgccttagccttctgagtagctgggactacaggcgcccgccaccacgcccagctaattttttgtattttctttttagtagagacgggatttcaccatgttagccaggatggtctctatctcctgacctcgtgatccacccacctcggcctcccaaagtgctgggattacaggcgtgagccaccacgcccagccaattt

SEQ ID NO: 92641 - DNA, 310 bp, Homo sapiens
agcatagtaattgtgttacatttcagaatatgtttctactaatttgcttttaatatattttttgaggacttggctataattagaagaagtgaatcagcagcagagctagaatttactcataatctctctctctctctcttttttttggagatggagtctcgctctgtcgcccaggctggagtgcaatggcatgatcacagctaactgcagcctccacctcccgggtttaagtggccctcccacctcagcctcctgagtagctgggactacaggcacagaccaacacgcccggtcaatttttcaatttttt

SEQ ID NO: 92642 - DNA, 499 bp, Homo sapiens
gttagccaccctggctggtgtctcactaggttgtgtgccccccacatccactggctctgagcccatctcagcaataggacttgcctaggaattgcagttattgtggcctagactgccttacaagtttatttagaaccccagagcactttagcccgtggtggcaaggttttctggaactcagtttctgacccctgagatatgtgattcccctctggctagggctggtttaaatgctccctctgtgctgggtgtgggctgaatttagcctggttctgctttctgtggcaacagggaatcactgagctcgatggacagtcccaaagcactgcactttccctcccccaagctctcagattctctctccatgccacatagctgggggatgggaggcacagtgctgtcagtgattcagtactgtctctcttgccctcttcagtgcctcttccagcaatataaagttaaaagcagatactgtgattgcttatctgaattttggttc

SEQ ID NO: 92643 - DNA, 859 bp, Homo sapiens
gtttgatttaaaaggccgaatttaaataaacctgcagctcattggcttggcaaatccagagactttcaagttgtatatgccaatacagagagcacaggagccgggctcatttactttgcccacacaacaaaaaaatgttaattgatgtaaagttgcttggcacgtggataatttagtcttacctgcattttaattgaaagaaacctattcatgtttctgatagtcaggttttgccatttaattttgtttaaaggcacctttgtgtagttgttccctcccactcctgctttccatgtgaatcacgttttcattaaaggtttgactaagtaaaaaaaaacaaacaaaaaaaaaacaaaaaaaaaaaaaaaaaaaaaaaaaaaaaaaaaaaaaaaagagggggcgcgcgcgcgcgccaaaaaaaaccccccgcagggggcgcccacaacaccgcagatcccgaccacattcttgtggtaacaaacagggggccccacaaagaggggagccgagaataaattacacacgaggcaagcgggccgacgctataaacaaacagcacggagagggggaaaacacggcgcaccagtggacaactctgaggaagaaggcacccaaaacaacgggagggaggagacacaaaacatggggcgaaaacacacaccaaaagaaaaattaaaaacacaccaacgagagagaaaacacaccacaacaccgcaacgggagcaaaacaggggggcacacacacaccgagcaacaaaatcactgcgcgcgagcacaaaacaatatgccgccaacagggaaaaataaaataacagagaaaacatcaattacccaggggcgcacacaaaaaagaacgggg

SEQ ID NO: 92644 - DNA, 200 bp, Homo sapiens
aacatatgtggttttaggatactgatgctaatacattcctcttttttcaaagtaatgataaagttcaaaaaagaagagctaaccattagttggtatgtggccagaatattaaggagtatagatttccctagaaattaaacaataatcttcggtataattcaataatatatttccctactatgtaatcaaaaataatccta

SEQ ID NO: 92645 - DNA, 272 bp, Homo sapiens
taggggctggacacggtggctcactcctgtaatcccagcagttttggaagccaagttgggagaattgcttgaggccaggagttcaagatcagcctgagcaactagacctcatttctacaaaaaaatttttaaaatgagctggatgtggtagtgcatgtctatgggcatagctactcgggagtctgaggctggaggatcaatgcttgagcctgcttgagtttgaggctacattgagcaatgatcattccactgtgttccagcctagatgacag

SEQ ID NO: 92646 - DNA, 251 bp, Homo sapiens
aagtttggaaaatacacaataatcaaaagaatataaaataaaggttacctgccatcatggcggaccacacagtattaactactatggacttttcagtgtttccctctagtcttttttctgaggtggctttgctctcagaggtggctttctctccccctgggaagggatatagctgctctgtaggagatgtgggggcaccaggctctctccatgggctctttatcacttctgacttggaggtcctttctcca

SEQ ID NO: 92647 - DNA, 536 bp, Homo sapiens
tttaaagcaccatagaaagatttgttaagttctatgtatttttaatttttaattatgatttctttctcgactaacatatgtatgaggctttttttcccatttcctagcgtgtatatttttaaattctgtgtttattgattcctgttttaattgaatttgaattgtggacagaaaataggtacatgttaagactgatctgttaatatttgttgagatttgctttatgacctagattataacctgtttttgtaaatgtttcatgattgcttgaaaagtatgcttgttttttagttgttggatgtccattagaccaaagttgttaattttgtagttcaaattttttccattttactattcttttgtcttctacttgatctctcagactctgagatgtgttgaaattttctattctagtgaacttaccaatttctccctgtaattctgtcaattttagttttatatatttttatatattttgaagtcttgttataaataaataattataaatatatacataaatataaaaatacataaac

SEQ ID NO: 92648 - DNA, 337 bp, Homo sapiens
ccagcctcgcatgagattttaacagagcaaagtacctgttggaaatcttgcgcacaaagcctcctttattctgttattcccactgacaggaattcagatacctggatcaattctgtttcggttttgctaaaatctctaacttgatattttacttttctaaaaacctgtattatcaatgaaatggaattaggaaaacaggacctatagaagttaagaccgcttcaatctattgatgtttcatggtgccttttatattcaaaatgctttgttctcacaaaaataatactttttgtttggagaaaaaggctgtggggggtgtgtgtgtgtgtgtgtgtgt

SEQ ID NO: 92649 - DNA, 653 bp, Homo sapiens
ctaagcttgccttcatgccagccctcatccccctctgtccatggctgttttattttcatcactggattgttcatgggttaatatttcccggtcacttttttgtgtttctgtctctcccacgggaatgttgtgtctgcagttgcatacccagggcctggcacttagtaggtactcagcatgtttggcaaatgaaatgagcatttgagaatgagggttgtgagccccagaccaggtcccacttgacttgctggccacagttattggtcctgttggggtctagtggccaatgtggttcttcaagagaaggttctctgctccccagtgatgtttaggtcttgggattcccactctccacacagactcaaagtcatccaggcagagacctccaaaacacttgttcttgggaggtggggagctgctggcaggcttgccaagctttccctggttgcaaggggattccccaggggttcctccatcagcatcatggagaaagggctggaaagaaaataggctgtggagccagcaagacttgcactgtttgagtctccaaacccacaactgtaacgtattcatatgggcttcacagggacacggggatgtcataatttttatttttattttttgaaatggaatctcactcactctgtcaccca

SEQ ID NO: 92650 - DNA, 827 bp, Homo sapiens
gcctgagacagtatgctgcttttcccctcctcctcctctccctcctaccagggagggaactaacttaaccctgtgtgcgcctgacactccctagagaagctgggatcgactaggaaaccgcaggcagcggctcccgggggcgagagctttgttcacgtgcgtttccagtgggtgtgttgctgtctaggggcactcgcgtggcaagacgcccgtggctggcttccagcgcccaagattcaaggaagggaaggagccctagcgtttcatccggaccagacccagccctcggagtctattttttgcctccagttaccggatttattgaagttgccagcgaagttggttttattcctttacttctctgctctccgcccccgtccacatcccccaaccctgtattatttcctgtcctagctgcgctttaaagattcggaacttttcactcgttctagctacagattttaactgtgttccgtgtgcgagacgaattgtggagggcacccacccacccatgccaagtgtaaatgaaaccgcaagaaaagctgcctcccactcacccatccagtgtccgagtaagcctaatgacacacattcacataactaagaagacacgggaagataggggtgcggaggacggagtttgatgtgtgaatgggaaatggagagaggggacagcgcgcgcgagagaaacagcgcgagcctgagccttagaatggaataaacgggaaacacacacaagaatgacgatgcaaaaaatgtatctaagtcccaacattgacagcagagggtcagctttaagcgcctacattttgatccgcgaaatttcc

SEQ ID NO: 92651 - DNA, 452 bp, Homo sapiens
aatgattatattgcttcaaaatacaagtacattcacatgtcagtactttgaatttgaaagctagtatttgtcaatcctaaaagtaatttactttctaagtagtaaattatacctaattaacttcaattcaggaaactgtaaactcaggtctaacaccagatagatttattataacttgtttcaaccatgaattgctgtgtttaaagattatattctttcaattattcagcagtatttactgagtgtctactttgtgccagacattgtactaattgaggagaatatgaagattaattaatcatggcctggccatcaaggagtcaaatgagccaatagatggcaacacagtatgaatggtatgaacataggtatggggggacctgaaaggctgtggaagatgtgtataaccttacatgaggctgcaggcattgtcgaaaggtatgcattgttta

SEQ ID NO: 92652 - DNA, 381 bp, Homo sapiens
gacactgaggtctgagaggagactcctcacaggtcttctagggagacactgagtgatgttgggaatactagtgatatcctaagccctagcagtgatgctgggggtgatatccctgggagaaggagagagaggaatggtgagaagtctcttgggttttagcttggccgaggaggcagtaggatgaccttcctatgagtgcacagagaaaagagttcatggtctgcagtttgaggatgttgagactcaacatcagtggtagcctgcctgcctctcttcttcccccctacctccttcctccctttctcaccctctccttccttcctgagggtgaattaaagaagacaataattgactttaagagccatcttttgttttctgctt

SEQ ID NO: 92653 - DNA, 871 bp, Homo sapiens
acctgaggttgctcagaggctgcaggaccctccagggcctgcgggcataacctgatctgtagctgggctcagccacaggccttcctggttggagttctgggctctcccaggcctgggtggcctctgtagctggtctcactgcccagagggaactgcacacacagacttctctcttacgttcatggctggcttgagatgagttgaaaataacttcgccaggccagtgtgtagaacagctggtccaaccagacagactttcacaccacaattacttccatgcctgagcaggatagatttgaagtgcaagccggaggcagcagatcaggagtagggacaggaaggacaggggatgcctgacctgacaggtggcttcaggcctcgggaatcacaagacatcctgaacacattgcctcctcatcttcttcctgctcctccacctcctcctctccttgtccttctcctctttgtcctcctgctttccgtatccaagtcttgtacttgtttaaatttattcctaaatattttattctttttgataagtggagttactttcttaatttcatttagattattcattgctattttatagaaatacaatggatttttaaatgttgatcttgtattccgcaatcttgctgaagttgtttaccggctctaatacttttgcggatttcttagaattttctgtagacagatcatgccatctccaaatagagatggttttacttcttcctgtctgatctgaatgccttttatttatttttcccaattgccctgagcagtacaatgatgaacacacgtttcaagagcagacatcttgtcttgttcctgactctgacaagaaagcataagtctctcaccatttagtgtg

SEQ ID NO: 92654 - DNA, 181 bp, Homo sapiens
ccaggcctagtgctcactagcataaactctgcaccagtgttttctcaagcctcaggacacaccccagtcaccaggaaggcttgggaaaacacagaatgctgagcccaccctgaaacttctgatgtagtaagtagtgaggtaccaacaggaacagaaaaaggcagaaacactaaagaagatg

SEQ ID NO: 92655 - DNA, 1592 bp, Homo sapiens
gaagacaggccttgtgcctaggaaaacagaagctttcttcttccttctactagtattgcatacttgtttttctggaatagggtgttaagttccttgattcagtccttgacaaggaatctcctttatacaagtgccagtaatgttgtaaaggtacagacatacgcaaatcataatttgttacatgaagtaccagtgctttcgtttttgttgttttttgagacagagtctcgctctgtcgctcaggctggagtgcagtggcgcgatttcagttcactgcaacctccacctcccaggttcaagcattcttctgcctcagcctcccgagtagctgggattacaggcacccaccaccacgcctggctgattttttgtagagacagggtttcacttcaattccatgttagagagctccgtgcctgtgtatacatgcctttatgtaagcttgctcagctacagatcaacaatgctggcactaagcaaaagttcgagcctcagctttaccttctaccctttcccttctcttttgaatccattccttagctttccctagtcctctccggatagctgttactctcctcttgccagaaaaatgaaggagctggtatcatttatactttttgtttgattatacgtttaaccaaagaccatacagtctcgtacctgaatcagacatttgcactttatatctaaatgagaagaaggggctcagataagtcgtttgctgccatctggaggtagatggacaatagctgagaaggggagccatgaaaagaacatcaggagtgatggacgcatagtccttccccaaagcctcgctcatcactggtaggaggcaaagcagtgggtcctcctcaccagccgcttacgggaccctgccatgcctggacccctctatcaggaagacctaccccagcactactggaaaatcagccaatcttaacccaaagatggccatgatttctgtatgtgagacgtcttaagggtgtttttgtttgttttaatcagccctcttgtttgagatttggcaatacatttctgttttctaggtaatttctgtgtctgatggtagaggatctaataagtattggaatgcttcctatttgctgatagaagtaccaaatagtattattgaagtctaacaaagactttttgttgagaacaccttgtagtgttgtactatctggaactcttgagctgccatttatatcactttttgtggagagcacatcttgattttcagttgtccttactttagaatacaacacacataaattggagactatgtattcatttcaatggaggtggtaaattgcctgttttaagttttacttaatgttgggttttggtagatgaggaaagcattttggttatttgttttgttttaaataccaaatttcttatattttttctggaatattaatactattaccaagctattatttcatggaatttgggtttctttttttttgtttttttaaaattaagtgctgtttgttttcttggttattgaacataatccaaagtagagatgttattactcaattcaagaaaagaaagggctaataaaacttaacttcaagtcagttttcatt

SEQ ID NO: 92656 - DNA, 221 bp, Homo sapiens
gttatatgtgtgttgcctccagtggcctatgagttttttgatggcagggctgtatctcatcaatctttgtattcccatcacaccatataggcatgcgcttaataggctcttgctgatgaactttcttcatgaaatgaaaacttttatgattaggcttggctctgtttattgattttacaattttagttctaatagctgactggttaggcgagatttccttt

SEQ ID NO: 92657 - DNA, 647 bp, Homo sapiens
ctccaaatatataattggggtaaacattcttaagacacaacctcgcattggtccttgctgtattgtaagaactatcataacagggaattctcccaatcctggaaagatagtatatcaaaactgatattatatcctgaggcatggcaaaaattaatgccatctttaggtatctaatggatatagtctccattgtgtcatcacttaattcattggtctgtttcctccaaaaaccagataaatcctgtaggatgacaataaactaccacaaacttaactaagtagtatctccaatagcaaccttcatatcagatgtatctttgcttgctatgtggtatgtagccattgatttggcaaatgaattcttttcctataagaggatcaaaatcaattcacattcacatgaaaaggacaatagtacacaattacaatcttgctccaggcctatgttatttcttctgccctctatcaagtgcagtccaaagagatctggattatttgagtattctaaagattttcacaatgatctatcaatgacatcatgccaatttggctgggtaagcaaaaatggttagcatagtggaggtcttgatatcacacatgaactttagaggttgggagacatgtcctatgaattttcaggtgcattt

SEQ ID NO: 92658 - DNA, 332 bp, Homo sapiens
acttttacttttccacagggacttttactcttccacagggttgttgtgcacagtaacaaacaaaatgcttgtaaaggccttttgtacactgctgctaaagaagagctcagagaagctgtagctgtgggagtcctgctctggctaaacagcctcagttagcatgaggagcccctgaaatttgagagtagtgcagagtgaagtgtggatgatacaaacagagggaatgaggcaggagattccaaaaaagaaggggtgaggaagaaaggtggaattttccttgggtaccaaagactaccatttcctacttcaccactctaactcaggccagctct

SEQ ID NO: 92659 - DNA, 235 bp, Homo sapiens
gttgcttaatttctgaagcctttaatttcttgcttctgaaaatacgaatactatcattccccactctactagccaattaagctgggtgagggtcaaatttcaaattccttgtgaaaatagtttatgaactataacacaatattaacactccccccatctccaacagtgtaataaccaagcagctgattctttactactagtgatagaggggaaagaggagaactcttactacttt

SEQ ID NO: 92660 - DNA, 405 bp, Homo sapiens
acttcactcgtacccagcgccctagcctcatatgaacccttagctaactccaaagactccagttacactcttctttcctttccctttctgtcttcaggtcctgggctttattttctcccatggcctcttttatctcagcctcctcccttccatgcacttcttagtgggataaaccacacatccccataggcatttgtagtactggggctgatgggatggggttacttgctcagactcagatgaagggcattcacagtccaggagcacctgagtctaagcctcatgagaaaatgccatcgtgggtcataactgggctctgttcagggcccaataagcacagccttaaaatggagtctcaacctggtgtccaggcctgtagacagagttcaggggtctgcgaacttg

SEQ ID NO: 92661 - DNA, 536 bp, Homo sapiens
agagagggagagagagagagaacgaacaagaaaaaaacctggatttccccccaagactcgactttcaggcaatgctcctagtaatattccaggcagtcaatgccactttctccagctatacttttggtcaagttgatattcctttatcccaagctattgtaagatccttacttttccacagagagagagagaaagagaggttttttggttgttgataaaatatttgaaattatgtgggttcatgaggaggaagtggtccacagcgtcacgtaagttgtaagctgaaaagtgctctttggatttagcaattaaggtagactatttagctggaagcatccaaacagtggattttaaaaatactcatctaacattaatgttaatggtagctggtatttatagcatttcccatatacctggtactcttctaagctccttacatgtattaacagattgatcaggtaggtagtattgttatccccatttgatatgcgaggaaacacagaggaagcacagagaggttaagtaacttgcccaag

SEQ ID NO: 92662 - DNA, 403 bp, Homo sapiens
cattaacattaaactcatggccaaaaccaccataactcatgcctaaacaaagcttatatctaacactcgcatattttctctgtaagatatactccagcctgggcgacagagcgagactccatctcaaaataataataataatagcaagtaacttcaatacatcattctctgtaatggataaatcatccagtcagaaatcaataagcaaacaacagaactgaacaacactatgaacccaatggacctaatacgcatatacaaaactttttgccaaataacagaagaatagaattcttcccaagtgtacacagaatattctttaggctatataatcacaaagaagtatcaacaaacttaagaagatgtaaatcgtcctaagtatcttttcccaccataatggaat

SEQ ID NO: 92663 - DNA, 268 bp, Homo sapiens
atctccccgtgtcctgtgctaccttcccaggccctgtactatccctccgtgccctgtactacgttcccaggtcctgtattattcctcctcagggtcctctactaccttctcaggtcctgtcctatctctccatgtcctatacttccttcccaggccctgttactatacctccatgccctgtactaccttcgcagttcctgtatgatcattcccgtgtcctgtactaccttcccaggtcctgtactatccctccatgccctgtactacc

SEQ ID NO: 92664 - DNA, 478 bp, Homo sapiens
acccgcattgagaggggacccaacagggttgggccatggggtcactatcagataaagagcagaggcaagacgggctgataaccaccaaaggccattaaaacctggctgccccaatgcactagggctctaagagatttgtggcttccttttgggggggaaatcagggtctcttctgaactccctcctctgccagggaacccacactcaaatatattaaaagactaaatgattaataaataatcttcaggaattggagcaattcagagtctcaagccattacatgaaagtatttattttcttctaaaaaatgaaaaattatacatattgcttttatgagctgtcagaattctttctagcagaaaccataataaccatagagtttcctttttaaaatgacttttggcaattcacttaaaaacaattaatttgttttattgagtgataatctataggctactaaaaatccaaatacagagct

SEQ ID NO: 92665 - DNA, 122 bp, Homo sapiens
tagacaccagaggaggttgttaaagtaggggtgctttgggagcagttagaataggtagtcatggaatagcgtgatttatagggaatgaagtcttatatcttcactccagcacttgatgtatc

SEQ ID NO: 92666 - DNA, 265 bp, Homo sapiens
atcaaacatcatttaatttaatatagtttaactatggctaccttgctctttatgaaaagaacacctaatttttaaaacaactaataattttattagactcaaaagccttaggggaaggtactcatgatgccgagcaatgcggcccacagtcagggtgtgagagttagctgagtgtggagggtccttgcctccttcccccttggggcctctctccagctgtctggggatttcgttctctattttccagcactgagctaaggatatt

SEQ ID NO: 92667 - DNA, 210 bp, Homo sapiens
ggggtttaaatggcacgagtggggaatagtcatataccctttgaacataaaaggaagctgccccaaatcaaaagttttaacaaataatgttgagtgttcagctgggattgggaaccatgagtttgtaggaaaccactcttcttagttaagtgatttattatacagtgttcatttagcctgctataaccatagagaagtctgattatagaa

SEQ ID NO: 92668 - DNA, 236 bp, Homo sapiens
cctccagagtagctgggaatacaggcacccaccaccatgcccggctaatttccgcatttttagtagagacggggtttcaccatgttggccaggctggtcccgaactcctgacctcaggtgatccgcccaccttggcccccaaagtgctgggattacaggcatgagccaccgcgcctggccataaacagaaatttcttaatcaaagctggacacaatgacggccttgatttagtgca

SEQ ID NO: 92669 - DNA, 457 bp, Homo sapiens
gtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggcc

SEQ ID NO: 92670 - DNA, 438 bp, Homo sapiens
tcaagcgattctactgcctcagcctcccaagtaactgggattacaggcacgtgccaccatacccagctaatttttgtatttttagtagagatgaggtttcaccatattggccaggctggtcttgaactcctgacctcaggtgatctgcccaccttggcctcccaaagcactgggattacaggtatgagccactgtgcgcatcagataacggaatgctgaacagtgatttagagggagcggcccaggcaaaggcctggcatccgggaatggcatcggagcaacattcctaaaattgaagcagactctgggaatccacccgtggagaccctaggctgagaacctcggagtcagggtggctgcgggagggcagacagggaggccaggacagggcagtgcgttcggccaggtcacaaaggcctcgaatgccaggtcaggagc

SEQ ID NO: 92671 - DNA, 103 bp, Homo sapiens
acccagcagagtatagcatacagtaagtgctcaactgaaagcagctaatcacttcaggcacaaggctgagctattttctagttgcagcggtccaatcttctta

SEQ ID NO: 92672 - DNA, 120 bp, Homo sapiens
acaagggaggttgggattctcatggtggatttctgcagagcacagttgagtttggttatctgggttcagtccgtgtcaggtcctacttgtccagatgcagtcccaaccctcttttctcgg

SEQ ID NO: 92673 - DNA, 345 bp, Homo sapiens
ttgtatttttagtagagatagggtttcaccacgttggccaggctggttttgaactcctgacctcaggtgatctgcctgcctcggcctcccaaagtgctgggattacaggcatgagccacagcgcccagccaggatgtcagcttttgagagcagaagctgcatctgtttttgtttgtcgctgaatccccagggcttagaagactgcttggcacattccctaaatgtttactgaatgaataattagcaacctgacattttgcacaaatttttccttgtaggacttcttgaaactgatttgtctgctgttatatctgacctatttcctgcttatagtttatattctcc

SEQ ID NO: 92674 - DNA, 161 bp, Homo sapiens
taaacctgtagtgatgctggagcactggatttcagagaaacactgggagttaagtgactgatgagttctgaagcattttagcttgaggcaaagattaagtaaacatttgtatgccaaacatcaactaagtgcatagggaagggcagatgtctctcttggga

SEQ ID NO: 92675 - DNA, 462 bp, Homo sapiens
tagaagactaacggggaaacatgaaagggtgaaaatcttctgtcatgacacatcgttgctttcaaataattcagtaaatgagagtaagggaacttttaagataatcaattatgtattccagctgtaaaaataaaaagaatcttagcacaatgcatttttaattttaacatatctattcaaatactgtgaaaactatgttgtagaatctctcacaggttgctttgatgcttcatttttagtctacaggtttggacctacaagggtggtttctaagagttgtctcttccctgtcatatatttgtcttatgactaggatattctgcttcttgggaaatactgtgctttgattatatataaccttctagtccaacagttaagctatctataggaatgtttgctttcagaaacaattaggcttaaaaataaagactgtgctcaaaaataataaacttacttaaaaat

SEQ ID NO: 92676 - DNA, 373 bp, Homo sapiens
tgtagagacagcgtcttgctacgttgcccagcctggtctctaactcctggcctcaaataatcctcccatcttgacctcccaaagtgttgggattacaggcgtgagccactacacaaggcataggagtctctggagaccacactggtccctgccacactcaccaccaactagactctttcctggttacaacagtgagacatccctaccttacagcgacactgtcagaatttgcaaaaccagggataactcggcagaatctgctatgccagagaccaagagatgtgaaatgttgaaaactgtgactgggctatgctggggaaaggagtatcagacccgcagccagtctccaatcagacaccagtgatccttgctt

SEQ ID NO: 92677 - DNA, 363 bp, Homo sapiens
ttagtttactgcgcggccaaaggactactccaggcaccagtgaggaagggtaatttagatttctagtgggcaccctgccggcccatttcataacaatcagggggcctggagtgggggggcttgcgggtagttgatatcaaatcccggtctctctcacttccgctcaatcggcttttggccaaagacgagtatcttcttcctggactgccttctcccaccccaacccagacaccaaggggacgcgacagcggttttgggacgctggctgatcatctgagaggaggcgatcccggcccgctgggcgttcaggatcccgatctggatgccgtccaccccgccccgccgggggctggggcgaaagcg

SEQ ID NO: 92678 - DNA, 375 bp, Homo sapiens
gtcattggcttgttttgataattttacaggctggcagtgacatggaacctattaggtttaggtccagatggtgtgcagctggtctggctgataggggaactagctgggtgaagaatctttcctgctgggtgggggccatatctggtgagagaaagcagggggactcagggtgagaccttttggatctcatgagggtcaaagacggtcaaggcagcagcacatgatatttcaggccttacaagatagtctgttacatttcttactgacaattttccttctctatctctatctcttcaatagtagcccaggattatctttgaggatatggaccaaatttctgccaactacagcctgaatacaagcatacaatcaaca

SEQ ID NO: 92679 - DNA, 654 bp, Homo sapiens
ggtccatgtgtctgaaaaagttcacattactagttaggaggctactgaggaaaaccagctgagcaatgaggaggacctaccattggcagatcctacctaccgtattcactggaagtgaatatggagaaggacagatgaatatatttatatatatatttacatttaggagataaaagtgaaataacctggagaaagactggtctagagtgatggtagcagagcagcagagataatagtattatctgaatctaagactctagagagaggaaaagattttgtggtgatggtggtgagggagtggtttaatagagcatttgagttcagttctgagctgaggtactgttaactattctggtagaaatgtccatcaggggctgggtgccgaggctcaggcctgtaatcccagcagtttgggaggctgaggtggatggatcacctgaggtcaggactttgagaccagcttggccaacatggcaaaaacccgtctctactaaaaatacaagaatcagctgggcatggtggtgcgtgcctgtagtcccagctacttgggaggctgaggcatgagaattgcttgaaccaggcagacagaggttgcagtgagctgagatcatgccattgcactccagcctgggtgacagagtgagactttgtctg

SEQ ID NO: 92680 - DNA, 791 bp, Homo sapiens
tcttcagaattgaaggagagatgttgtatcactgttagaaggctgctttgggacattctgcagcagggaggagggactgtcaacccctacaccatgaccaccaagttcctcaccttggctgagtccctaaaactctctgaacctcaggttcctccaagcataatgcagacttcacagagctgttgtaaagattaggtgaggtcaattgatactgcttaaaaggcccggtccgtagaagatgcccaataaacattactgctttccccctcaccctactgcctgaaaaaatattacacctgtgagactgactttgagaaccagtgtgggtggggagttgtgcatataaactatttaatgagtaccaaacacaaaagtcaagcttgtaaaatatcaggccttgccccagaaagacaaataccacatgatctcactgatatgtagaatcttaaaaagtcaaactcagaagcagagagtagaatgatggttatcaagggctgggggagggagggactggggagatgttggtcaaatgatacaaaggtttagttaggtggaataagttcagaaaatcaattgtacaatgtatcaattatagttaatagcaatataacatatacttgaaaattgctgagagtagtgtgagtgttctaccacaaaaaaatatgtgcagtaatagatgttaattaccttaatttagtcatttcacaatatgtacatatataaaaatatgttgtatgccatgagtatatataattattatttgtgaatttaaaaaataaaaataatttcca

SEQ ID NO: 92681 - DNA, 564 bp, Homo sapiens
cgagcggagggcccgatgggtgcccggacgcggaagaactggcccagcggaggttcccgcttctgaagcgtgggaggcggaagagactgcaggttgtagattttggtcttggccccaacgggttcccccagaccattagaacccgagagaggaagaggaggcaccgcggcggcggctgagaggccgaacccccaacctgtcctcgaggcgggaggggggcagggaggggagaagcaccgatcccagggctgaggagcctccgggaccgggtccgggagcatggggggctggaccgggtccccgagcatggggagctggagccgccaaggccgcccggccgggtcctacccgactgtcaggtcctcggtgctagcgctgcccgggcagccgcagcatctgtagcccggccccgcttgtggtcctcagccggaaagatagcagcatgagttccgccgctgcctagtttcctccccctcctcttctccctcctctctcctcttcccagaccacctccttctttcccgcccctgcgcttcttttcccttaccctctgtcctcctccct

SEQ ID NO: 92682 - DNA, 3570 bp, Homo sapiens
cgagcggagggcccgatgggtgcccggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaatttaaaaaaaat

SEQ ID NO: 92683 - DNA, 3205 bp, Homo sapiens
cgagcggagggcccgatgggtgcccggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaatttaaaaaaaat

SEQ ID NO: 92684 - DNA, 718 bp, Homo sapiens
ggcatgtcacgaggaacgtttattgtaggttaggcggtctggtgcctctaggggggacaatcaaatgatacaggacctcgaagagtcttactttggatttctgtggctttataatgtagtatattatgtagttcattgctgtggctttatgcttttttattatttacaagtgatttactgatttgtgagctcttgaaactgtgtcattgcatgttatgtttaccctgatagttgcatttgcttataattctttttgctttgtcttcagttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctat

SEQ ID NO: 92685 - DNA, 2338 bp, Homo sapiens
aaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccattaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggttttttttttttttttgttttttttttccatttcatttaactgtgctttctccacttttcatcattttgtgtttgatgatttaaaagaagcttgactattcctcagctcttgtgccaaggagggtttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaataggggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaatttaaaaaaaat

SEQ ID NO: 92686 - DNA, 3627 bp, Homo sapiens
cgagcggagggcccgatgggtgcccggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgttgctgtcatcctcacctaatcgtattcctagtagcagactgcatcagatcaaaagggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaatttaaaaaaaat

SEQ ID NO: 92687 - DNA, 2641 bp, Homo sapiens
cgagcggagggcccgatgggtgcccggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaatttaaaaaaaat

SEQ ID NO: 92688 - DNA, 417 bp, Homo sapiens
aagtaagataaacatacaaattttagaaagtacaagtaaatcaaaagttaaatataaaaaaagactaaatagtagttttgcaaatctaatgatgtagtataagaataagactttgagcataagacaaataaaaaatacacatgggtcataaacaatcacaaaaacagcctatgactgtacatttgacaaaccagccgaaatggaccaaaccaatgtatggaaattgagtaatggtatgttgaagtttattagaccagttacttgaagtttttatgtaccaattgctgaatgttatgtgtctggtactattctaatcctgggtgtaaaacaatacataaaaccaaaaccctgccctcatgaagtttgcattccagtaaaataaattcatagttatatttcgggtggtaatatttttgt

SEQ ID NO: 92689 - DNA, 625 bp, Homo sapiens
gacaccatcattatactgtgtgtctttataaaacccatataccttattcttttgttttatctagctattatattgtctataacttacttttaaatattctagtatagacaggtgtgtgtgtgtgtgcgtgtgtgtgtattcttaatcctctataaggttgtagctaaaatttaaaatactttaactggacacacatcttttaggagtggttggtagtgtttgaaggactactataaggccttaatgatctttatctctagagagttctagaaggttccctaattagcctaataaataaaagaagttattttgcactggaaaattaaggagtgttggagatatgtgatttggctagtgctatttaaagacacccctgtccttgcataaatagggtttaggaatctagtaatcctggattacaaactttgtttggagtgatgcctaaaccaggtatgccaatctgtcttgtgtccacatactaacagagggttctagcaacttaatcccattagcatgttagctgaagactactgctagaatgctgttatgtttgtttagagttaatatttcatggaaatgtctgaaccctggtactgtattaaactcatagaaatggctttgtgcc

SEQ ID NO: 92690 - DNA, 996 bp, Homo sapiens
ttcatggccgccgcctggcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggccctgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaaggaagtggagaaatccttgccaaggaatccaattcaagtcttgtgacccgtaaaaaccgtgaaggttacaaggaagcacgaccagtcggggcaagttgtgtactgaacagcaattgtgagaggtgagccatgccaatagggacaatcaatcggacatacgcccgtggtaagaattcgaggcaagatttaagagggtcaacacagattactgacaaggccgtgctatggagacgcacaaac

SEQ ID NO: 92691 - DNA, 627 bp, Homo sapiens
tcatccagggggcggggctgtagattgttacattcgcctgggcactcggctcggtccaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaaaaacacccggggatttatatgtgggggggggggaaacaaaaggagtgtaagtatagaagtggccacagtggtgctaaaaggtggttatccccgagcaccaaagtattattatgtggctaccaacgggtggtaaaaatgtggcagagatccaccatatatatgtgggacggcaatataaattcgggataaggccgaggtataaacgtggcacataatgagacg

SEQ ID NO: 92692 - DNA, 2745 bp, Homo sapiens
agcgggtgagagtcagtgagctctcaggagatctgctgtttgaaagtgtgtagcgcttcccccttctctctctctgtcctgctgcactatggtgagatgtgtcccttccgccgtgattgtgtgtttcctgaggcctccccagccaggcagaactgtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92693 - DNA, 2855 bp, Homo sapiens
aaattgcatgctggtactggcctgaggtttattggatcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggccctgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaaaaaaacccgcggccttcttttccgcgggcgcggcaaacggcgcgtctcgcccctgccccctgggcccaaagcatcgctccccgggaacccgcgcgtttcttgtggccaccaaggtcggcaacaatctgtgccggggctccccccataatacgcacgccccatataccactccccataaacaccccgggtttacccccctgcatattatacacatcctccacaaactctcctacaactctacccacacaacccccccaaacctcccaccatcacactcagccatcaccacgtacctatctcactatactcacgtcttctcacacctaccactcacaccctcccctataccaaccacaacacacccctaccactactcactcatccccacgctcctccttacctaccacacct

SEQ ID NO: 92694 - DNA, 2276 bp, Homo sapiens
gctggtacggtccggagttttaggatcgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92695 - DNA, 2539 bp, Homo sapiens
agagatttatctggaaggcctggagaagcaactcaagcacaagggatctgaggaggagccagggagcacatttccagtttaaaggggaaaaatgtctccctggagagccccaggcagtccttgaaagagaagcttgaaaagtcaagtttgggtcttctgcagctcgggcaccaccgagtcatagtgagtgttggcctccgcaaggcctgacagcacagaggacagagaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92696 - DNA, 1833 bp, Homo sapiens
gttagcatctagacatcccttattgtgttggcgtgtggttcttgtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92697 - DNA, 1690 bp, Homo sapiens
gagatggacgtctcactctgtcgtccaggctggagtgcagtggtgtgatcacagctcagtgcagtgaactcctggactcaagccaccctcccacttcagcctcccaagtagccgggacaacaagcacaagccaccacacctggctaatttttaaaatattttgtagcgatgggggcctccctgtgtttcccaggctgatctcgacctccgaggctcaatcgatacccccacctcggtctcccaaagtgttgggattacaggcttgacggacttgtgcccgggcctgggcttttttggaatgagtcttcctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92698 - DNA, 3168 bp, Homo sapiens
aaattgcatgctggtactggcctgaggtttattggatcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggccctgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92699 - DNA, 1389 bp, Homo sapiens
aatgagtcttcctggtcccgacagttctcctgcatgtccttgtggtggccagtctctgttctttgatgacgaatttgctttctgagtagagtctggtcacctggagctggtttggtggaataaaggacaatggggttctaggatgtagctgggagatacaagctgtgagtactctaataatgagataagttttcttatgcaggccccagttggtcctgaagtccttcctcaaagaggcgatcctgaaacctacaccaagtgacgtcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92700 - DNA, 3219 bp, Homo sapiens
aaattgcatgctggtactggcctgaggtttattggatcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggccctgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92701 - DNA, 2530 bp, Homo sapiens
gcatgtctgactagctacctactgtaacaatacagggagcctcagagtcccaagccctagatactagtcccagctctgccaccttggggcctttgttcccccacctgagaaggagaagagctgagctctaagtccccgctccccggctctggcattgggggttacagcccttcggaccctcattgtcctccctccgtctggaagttgcctgtctgctgaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92702 - DNA, 2479 bp, Homo sapiens
atgaatgggatgagtgtcctgatgaaagagaccctgaagagctctgtcaccccttcaccatatgaggagactggggaaaggcagccatctgtgaactgggcagtgagtcctcaccagacacagaatcagtgggcacgttggtcttggacttcccagcctctagaactaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92703 - DNA, 3164 bp, Homo sapiens
aaattgcatgctggtactggcctgaggtttattggatcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggccctgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatggtgattcatgttgtttgttctctgatcacagtttcagctgcatgaaggctctgaatcaagtgtgtactcaatgccattggaatccccacctcccctgatgaagatgagtgcttacaggagatcctaaggaccaaggagagggcacatctgagagggtgtcagagagggtagtattggcatgtttggttcaaagcaaggaatcatttcattctaggtattggcaggtccacctgcactggggagcaaaagcatccccatttcttctcatccctcttaccctagactgcccagttacatcctgccctgaagaggtggagcagatatctttcccagccctctgctgtgacagaattggtctgttctctcacctacttgatttcctatttataggtaacaattcttgaatgcctgctgtgcaccagccattgtattgggggatttattacgctattgataatgtttatgaaaacttcatgaa

SEQ ID NO: 92704 - DNA, 678 bp, Homo sapiens
aaattgcatgctggtactggcctgaggtttattggatcgccggggctaagtggccgccggcgtccgggtacccgagggctctcccgcggcgctggccgtctgcgccttctactacctcggctcaggccgggagaccttctccagcgccaccaagaggctgaaggaggccctgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagggtaacctgggcttccaggagcaatagccc

SEQ ID NO: 92705 - DNA, 1137 bp, Homo sapiens
  misc_feature (943)..(943): n is a, c, g, or t
gtatcattctgtgtgccattgtactgtaccagtgtattaaaatttgtttaacttaatgatgaaaaattgctttaaatttttcagccttatcttttttttttatttttttgagacagggtcttgctctcttgcccaggctggaaggcagtggtggggctcaatgcagcctctacctcctgtgcttaagcaatcctcccacctcagactcctgagtagctgggactacaagcatgcatcaccaaacctggctaactttaaagaaatcttttttttgtggagacagagtctccctatgttgtctaagctggtctcaaactcctgggctcaagtgatcctcttgacttggcctcccaaagtgctgggattacaggcgtgtgccaccacacccagcaagttattcggcattattaacaactcttttgttcccccacttctctattttcttaggataaattcctagaagttagatggctgggtcaaaggaccactatacatgctttggaaaggtttcaaaaatctatgctcctgctagtgtttcctcacagccatttctgtcaatctgatagtggaaaaaaccaacatggaattgttttgtcttgcatgactgagtactaactgaggctgaaagtcttttttttttctaaagtcccaattttattgagcatttgcatttcttcctttgtaaaccgcctgctcttgaccttcgtccatttttgctatcaggctattttgtctttttttttttttcactgatttaaaaaacttccagatattatagatacttattcttcttaaatgtctgcaagtacttcccccactttgttatttctcttttaatatgttcagaaaaaaagaatgacatagcaattaagaatcaccatgtcggcctggcgcggtggctcacgcccggcccattgtcaatgttttaatgtgtgcccttccngatttcttcctctacaaggcttgcttgcacacttaagcatgcacatgcatgcaaattgttttacaaaaatgagatcacactgaacatgctactttgcaccctgttccctttggttaataaatatgaagaacattcagtgtcaaccattacagacgtaacatcatccttttcagagtcacacagttttatagacc

SEQ ID NO: 92706 - DNA, 217 bp, Homo sapiens
atcattcctgattccaaaatgcatcctcttttagggataggtgaccataatattataatgtcatctcacttaggcagagtcatcttccttaaatgagtcaactcatggaagacaaacaccaggtgggtatgtctcagtgctcagtggtgattcaaaattttgggccaaacacagtggctcatgcctctaatcccagtactttgagaggccaaagtag

SEQ ID NO: 92707 - DNA, 919 bp, Homo sapiens
ctgctcagacgtccctcgggcacggaagacggtgcacgttaatcacccacacacacactatgagggtaccaggccaaggtcagagtcctgcaggatggggaaccgacccctaagaactcctgagctgggtcaggtcagggtaccactgtgcacaaacaggatggtgtgttcacatcgcggtcatcagtggggtttgtggagctggggttctctcctgcagcttcaagatcctcaaccaggacaccagaatttgcttgtctacttgtgccgtctcaggttaatttatgtctatgacatgaatctccgctctttacatggggcaccttgagcaggtgaaacctgcaggccccctcgtggtgatgatgagtgggagccctaagctgctcccccaggaactgcacctcttctctacctcctcagcccagatgaaccatcccaatacctctcctcagtcaccctactttgctctcccaggccagacattgggtgctcctattagaagagggagaggtgacctaggatacaagttgaatcccaaggaattgggggacaaagaaagcaactaaaagactgatgagatgaggagaatggccaactagtggcaaacaagagtggcttatttgactgtggctccctaggtcagcatcctgggtactaatatgtcattccttttaaatctaagattacagtacaaccaagacatggcagaagcattatgaccaagccagaagcatagtcctaaggatgttttgacctcaataaactaaccacatacatgcttccagactgaaacaatggagggatatttgcatcagattgcacagaggttattaaaacagatcaatacataataatggggatctagaattaaatatatttattattaaactccctgatgacacacaaaaaaaaatctctg

SEQ ID NO: 92708 - DNA, 643 bp, Homo sapiens
ctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaa

SEQ ID NO: 92709 - DNA, 261 bp, Homo sapiens
ataggatgagtgccgttgtaaagagaccctttgcccattctgctgtgtgaggacactgtaagaaaggaggcagtccctcaccagacatagaatctaccttgattctggacttcctagcctccagaactgtgagaaataaattcgtgttgttcataagccacccagtccatggtatgttgttacggcagcccgaacagatcaacacagcgtgcacgttccttgctgctgtttttgagccttgcccattaaaaaaaaaaaaaa

SEQ ID NO: 92710 - DNA, 317 bp, Homo sapiens
gcggccgcctactactactactactactaattcgcggccgcgtcgacaagaaaggtaaaatgttggattttaagcaaagtaggattgaccagagactgttctgactttgacattcagacctttcagatgttcttccttcagaccagtccaagacactcagcatttccagccaagttgtcttttttttctgccaataaagtattcattagttgacgtttgtttgtattttaagtaaagtcaattttttttaaagcattaatttaattcacgggtatgcctttcatttctctggccttcagttggtttaaaaaaaaaaa

SEQ ID NO: 92711 - DNA, 1199 bp, Homo sapiens
  misc_feature (29)..(29): n is a, c, g, or t
ggctgtaccgggccggagtgcgttagggnttggcaacatcatgattattaatccgtcagcctttaatgtggtcactgtttcttatccagaccctgactttctagtagtttattttgctagcccagatttctgcttaaccaaatataagggagtttcagaggggtgatcttagctgtcacctagattctgtcagccaaccagtgattgtctggaatatcttaggaaatgaactgtaattgtcagcctcctaaaatcaatttttttttttttttttttgaggctgagtcttgctcttgttgcccgggatggagtgcaatggtgcgatcttggctcaccgcaacctccacctacagggttcaagcgattctcctgcctcagcctcccgagtagctgggattacaggcatgtatcaccacgcccagctaattttgtatttttagtagatacggggtttctccattttggtcaggctggtctcgaactcccgacctcaggtgatccgcctgccttggcctcccaaagtgctgggatttacaggcgtgagccaccgcgcctggccaaaataaaatgtttttatctttcttcacttagaactatgaaggccttttcttgttctggtaaccccccacagtgtaattggtgctgaaaatagtttcgtgcctgaggtctgttgtcactcactcactttctgacaattaggtgagccacttgaggattttctggcctgaagttataaaaacttggcatctgtcctaaggtaattgtaaaggcaaaatgaaagcattgaggtgaatttaggttatatggcatttatctggtaatgtgtttcagaaaagctagaatgaaaatgtgatgtaagggatagcaagtgtaggttgattcataattcttggtataaaaccaagttttccttagtcttgaggaatttgaagaaaggtaaaatgttggattttaagcaaagtaggattgaccagagactgttctgactttgacattcagacctttcagatgttcttccttcagaccagtccaagacactcagcatttccagccaagttgtcttttttttctgccaataaagtattcattagttgacgtttgtttgtattttaagtaaagtcaattttttttaaagcattaatttaattcacgggtatgcctttcatttctctggccttcagttggtttaaaaaaaaaaa

SEQ ID NO: 92712 - DNA, 959 bp, Homo sapiens
  misc_feature (29)..(29): n is a, c, g, or t
ggctgtaccgggccggagtgcgttagggnttggcaacatcatgattattaatccgtcagcctttaatgtggtcactgtttcttatccagaccctgactttctagtagtttattttgctagcccagatttctgcttaaccaaatataagggagtttcagaggggtgatcttagctgtcacctagattctgtcagccaaccagtgattgtctggaatatcttaggaaatgaactgtaattgtcagcctcctaaaatcaatttttttttttttttttttgaggctgagtcttgctcttgttgcccgggatggagtgcaatggtgcgatcttggctcaccgcaacctccacctacagggttcaagcgattctcctgcctcagcctcccgagtagctgggattacaggcatgtatcaccacgcccagctaattttgtatttttagtagatacggggtttctccattttggtcaggctggtctcgaactcccgacctcaggtgatccgcctgccttggcctcccaaagtgctgggatttacaggcgtgagccaccgcgcctggccgcctttctctctttacatcgacccacattagtgttgtgtagttttagttcctgaagatagggatggtcaaagatctgtttattgatgtttcagggttgttttggagatggactgtttttattttaaggaatcagacttctaatatttgccagtggttagagtaagagccgtccttctttgcgcttctcagcatcttctgtttcacagtctttggcatactctttacgatagcgttgtcctttgtttgggtgtctttttttgctgctgctgcagtttttgtgtcacatatcctcagagagattcggtgatgtcctgcttctccctcttccgtggtctattctttccgtcgtgtggtctcgtcctcttcactgtgaatggctgtgaggaagtgacagatgaa

SEQ ID NO: 92713 - DNA, 338 bp, Homo sapiens
tgtagggtccccctcatctgccttacaccctggaagaaacagaggcctctgacctcactctttcctaaagagcagctctttcaatcaacagactttcactggaacacctaccttgcaccaactattctgaattcagagtccatctcttctctctgggaatgtacaggctaccgagacagaaccatggaaacaaaactggaatgaaatatgattactgtaatagagatcccccaaaaggaagaccacagagaagaggagtgagtgagaaggttccaagaaccaactctccctccaaactcaccagccaagtacctaaacccatatcagcatagaataaa

SEQ ID NO: 92714 - DNA, 1277 bp, Homo sapiens
ggcacgaggagcaagctcggtggctgggtgggttggggcgttccgcgcgcccttcattgaagcggcggtggccgggctgggcgccggtagtggaaagcgacggcgcggctggaaaatgccagtccattcccgaggggataagaaggagaccaaccatcacgatgagatggaggtggactacgccgaaaatgaggggagcagctccgaggacgaggacactgagagctcgtcggtctccgaggatggagatagctcagaaatggatgatgaagactgtgaaagaagaagaatggaatgtttggatgaaatgtccaatcttgaaaaacagtttaccgatctcaaagatcaactttataaagaacgattaagtcaggtggatgcaaaactacaagaagtcatagctggaaaagcaccagaatacttggaaccgctggcaactttacaggaaaatatgcaaattcgtacaaaggtagcaggaatctatagagagctctgcttagaatctgtaaagaacaaatatgaatgtgaaattcaagcttctcgccagcattgtgagagcgaaaagctgttgctatatgatacagtccagagtgaactagaggagaagataagaaggcttgaagaggataggcacagcattgatattacctcagagctgtggaatgatgagcttcagtcaagaaaaaagaggaaggatcctttcagtcctgacaaaaagaagccagttgttgtttcaggtccatatatagtttatatgctacaagatcttgatattcttgaagactggacaacaattaggaaggcaatggctacattggggccacacagagtgaaaacggaaccacctgtgaaactggaaaaacatctgcacagtgctagatctgaagagggaagactatattatgatggtgaatggtatatacgtggacaaacaatatgtattgataaaaaagatgaatgtcctacaagtgctgtaattacaacaattaaccatgatgaagtttggtttaagaggcctgatggaagcaaatctaagctttacatttcacagctacagaaaggaaaatattcaattaaacattcataatcatgatttaagtgttatctaaatttaccttattagtgttaccaaatgtaagtgccatgagagtaaaaaaatgtattcaataacttaatattctcactgaatcatgagagaatgtgtatttgtaggtagtactctaaatagatctcattgatatgttattaaaagaaacagtaataaaaattttatcacg

SEQ ID NO: 92715 - DNA, 359 bp, Homo sapiens
  misc_feature (39)..(41): n is a, c, g, or t
  misc_feature (77)..(77): n is a, c, g, or t
  misc_feature (80)..(81): n is a, c, g, or t
cgggagcgcccgccctggcccgaggggttggtatttttnnngccaactcggtctgtaaacacattttatgaccatgnagnnaatttggtttaagaggcctgatggaagcaaatctaagctttacatttcacagctacagaaaggaaaatattcaattaaacattcataatcatgatttaagtgttatctaaatttaccttattagtgttaccaaatgtaagtgccatgagagtaaaaaaatgtattcaataacttaatattctcactgaatcatgagagaatgtgtatttgtaggtagtactctaaatagatctcattgatatgttattaaaagaaacagtaataaaaattttatcacg

SEQ ID NO: 92716 - DNA, 1871 bp, Homo sapiens
tgttatttaagaaatatttttaggccttttttacatatgcatggattgatgttaattgttaatgttctgaccctttgttcttctgacagtgttttattaatataacagtttttgaactgatccctttagcacctgtgaaactggaaaaacatctgcacagtgctagatctgaagagggaagactatattatgatggtgaatggtatatacgtggacaaacaatatgtattgataaaaaagatgaatgtcctacaagtgctgtaattacaacaattaaccatgatgaagtttggtttaagaggcctgatggaagcaaatctaagctttacatttcacagctacagaaaggaaaatattcaattaaacattcataatcatgatttaagtgttatctaaatttaccttattagtgttaccaaatgtaagtgccatgagagtaaaaaaatgtattcaataacttaatattctcactgaatcatgagagaatgtgtatttgtaggtagtactctaaatagatctcattgatatgttattaaaagaaacagtaataaaaattttatcacgatccttacgttgatttgcctcttaggtccgatgaccaataggtattctgtatatggtaggggtttctttctaaacatttttctttggttttaaaaaaagttatgcaaatttgtcttatctttagtaaactatgactacatttatctgcaatttttaaaattttccatatctttgtcattcattgtgtgtttgtaaataaggccgatagaatgtttcctataaatggtttgtactagtacattagtgttaaaccagaactgaaatttaaacatatatatatatgaggatgtatatatggcatcatcagcttatttagaactgatggccataccttacaatcttgttttacccaaaattaagctattggggttgaaagctaaaaggagcacttttgtagaatagcaacttttcttttcctctttcttgattgtatggtggggtggtgacctatttttacaaattatacctaatgagtaaaattagtgtaaagtgataacatgcttctacctgtatttctagtgaccctttagcggcaggtatttatacctggtatttatgatgcagtatataagtggtgaacaataactgacagtattgtgcttgctgtacatgtctggtcttttgaaacagattttagtaagcattttccagaggtaaaactgtgtccttattctaattttattcctagggcaaagtagacagggattatttccttgaatctatttccaaattaatatttttttctttggtatttctacactttaaggccatttggtgcaatttagaaagtgttggcctcccttccgctagccacattcaaaattaacttccaaaacctcaggaacagtacaaagaattgaaaccctcaatatggcagcacagccggctgtagtgtatatttagggtacaccaaatcaggtattcctggtggtcttgtgcactttaatttctgttacaatgagttaagaggatgaggaagaaatctacttattaacacttactgcagaaatgtctgcattattccgtttgttttcttattattttacctctccaaacatcttcctgtgcagatcactacttcatagttgccaaattttaaaacacttaactgctgaaattcagtgtcagcaaagtgatattacgttgttctgtttctaattaaccttagcaaatgtacataatgtcaaaacccaatagtatttgacagtacttatgtatacaatgtttgataagcatttttaataagatttgtatttttaaatttagtatataataaaaagatgtgtttcagtgtgaaaagtagtgtc

SEQ ID NO: 92717 - DNA, 2584 bp, Homo sapiens
ggcacgaggagcaagctcggtggctgggtgggttggggcgttccgcgcgcccttcattgaagcggcggtggccgggctgggcgccggtagtggaaagcgacggcgcggctggaaaatgccagtccattcccgaggggataagaaggagaccaaccatcacgatgagatggaggtggactacgccgaaaatgaggggagcagctccgaggacgaggacactgagagctcgtcggtctccgaggatggagatagctcagaaatggatgatgaagactgtgaaagaagaagaatggaatgtttggatgaaatgtccaatcttgaaaaacagtttaccgatctcaaagatcaactttataaagaacgattaagtcaggtggatgcaaaactacaagaagtcatagctggaaaagcaccagaatacttggaaccgctggcaactttacaggaaaatatgcaaattcgtacaaaggtagcaggaatctatagagagctctgcttagaatctgtaaagaacaaatatgaatgtgaaattcaagcttctcgccagcattgtgagagcgaaaagctgttgctatatgatacagtccagagtgaactagaggagaagataagaaggcttgaagaggataggcacagcattgatattacctcagagctgtggaatgatgagcttcagtcaagaaaaaagaggaaggatcctttcagtcctgacaaaaagaagccagttgttgtttcaggtccatatatagtttatatgctacaagatcttgatattcttgaagactggacaacaattaggaaggcaatggctacattggggccacacagagtgaaaacggaaccacctgtgaaactggaaaaacatctgcacagtgctagatctgaagagggaagactatattatgatggtgaatggtatatacgtggacaaacaatatgtattgataaaaaagatgaatgtcctacaagtgctgtaattacaacaattaaccatgatgaagtttggtttaagaggcctgatggaagcaaatctaagctttacatttcacagctacagaaaggaaaatattcaattaaacattcataatcatgatttaagtgttatctaaatttaccttattagtgttaccaaatgtaagtgccatgagagtaaaaaaatgtattcaataacttaatattctcactgaatcatgagagaatgtgtatttgtaggtagtactctaaatagatctcattgatatgttattaaaagaaacagtaataaaaattttatcacgatccttacgttgatttgcctcttaggtccgatgaccaataggtattctgtatatggtaggggtttctttctaaacatttttctttggttttaaaaaaagttatgcaaatttgtcttatctttagtaaactatgactacatttatctgcaatttttaaaattttccatatctttgtcattcattgtgtgtttgtaaataaggccgatagaatgtttcctataaatggtttgtactagtacattagtgttaaaccagaactgaaatttaaacatatatatatatgaggatgtatatatggcatcatcagcttatttagaactgatggccataccttacaatcttgttttacccaaaattaagctattggggttgaaagctaaaaggagcacttttgtagaatagcaacttttcttttcctctttcttgattgtatggtggggtggtgacctatttttacaaattatacctaatgagtaaaattagtgtaaagtgataacatgcttctacctgtatttctagtgaccctttagcggcaggtatttatacctggtatttatgatgcagtatataagtggtgaacaataactgacagtattgtgcttgctgtacatgtctggtcttttgaaacagattttagtaagcattttccagaggtaaaactgtgtccttattctaattttattcctagggcaaagtagacagggattatttccttgaatctatttccaaattaatatttttttctttggtatttctacactttaaggccatttggtgcaatttagaaagtgttggcctcccttccgctagccacattcaaaattaacttccaaaacctcaggaacagtacaaagaattgaaaccctcaatatggcagcacagccggctgtagtgtatatttagggtacaccaaatcaggtattcctggtggtcttgtgcactttaatttctgttacaatgagttaagaggatgaggaagaaatctacttattaacacttactgcagaaatgtctgcattattccgtttgttttcttattattttacctctccaaacatcttcctgtgcagatcactacttcatagttgccaaattttaaaacacttaactgctgaaattcagtgtcagcaaagtgatattacgttgttctgtttctaattaaccttagcaaatgtacataatgtcaaaacccaatagtatttgacagtacttatgtatacaatgtttgataagcatttttaataagatttgtatttttaaatttagtatataataaaaagatgtgtttcagtgtgaaaagtagtgtc

SEQ ID NO: 92718 - DNA, 141 bp, Homo sapiens
aagaagagataccacgggtgcacctgcacagaggaaaggccacatgaggacacggtgataacacagccatctgcaagcccgtaagagaagactcaggagaaatcagacctgccaacacttgaacctccatcctcctgacct

SEQ ID NO: 92719 - DNA, 314 bp, Homo sapiens
aaacttgtagattgagtcccagaaatactgttagtgcacttaaattataaaactgtttacctgaagcagcactgagcaatcctttggatatacttttacctgtttttattctaataaaaatgactagtacaaggaaaattagttggtttttagcctgaattgtatgttttgatttgatttttatttctccacattattttgcttgttagcttttcttcaaaccagtatcacaaatggatgctgtcttcactcagacctgactttggtaaatgaaatattatgttctgtaataaatatgaccttcagtcatatag

SEQ ID NO: 92720 - DNA, 435 bp, Homo sapiens
gtattttttttttgagacagattctcactgtcgcccagactggagtgcagtggtgcgatcttggctcactgcaacctccacctccaaggttcaatggattctccagcctcaccctcccaagtagctgggactacaggcaagcgccaccatgcccggctacttttttttttagtagaaatggggtttcaccatgttggtcaggctggtctcaaactcctgacctcaaatgatctgcctgcctcagcctcccaaagtgctgggattacaggcatgagccactgtgctggccctaccatcctctttttgcattcccagaacacaggctctagtgcacattagagactcagtcaacatttgttgacctcaacagcaaaggtaggctatgggattcagaagataaaatgatgtaggaaagaatgtcagcttcatagattg

SEQ ID NO: 92721 - DNA, 860 bp, Homo sapiens
ccagagtgtcctcaggggcatgagaagacaagggggtcaggagaggggcaaatggagaaaagccacagtgacacaaattcctgcttagattagtgtgacccaaatatatccggatgcctcaaggccattctcatccacgtcagcacttaaaactaaaactgcaactcaagcaccaaagtaattggtgaataatatggaatttgctcaagatttcagaggaagtggcttatatctatactacacagcaaatctttctaaaaatcccttttaaaggtttttcttcttcacccatattccattccctttagcaactctgtacttccctattctccttccatacccctctcctctgtcttccccttctgtttcctcccttgtgttcatcactattttagaggcttaaaacacaagcgtctttactattttaaataatatgtatatatgtgtgtgtaacatgaaacttcccattttaactattttaagcgtacaattcagtggcattaaatacattcatgaaattaaaaaattcttttgatatataacagatgtacatattttcagggtacatgtgataatttaatacattcatatattttataaaaatcaaatcatgtcattaggtatcctttacctcaaatatttctttatgctagaaacattcaaattattctcttctattttgaaatatacaatagattattgtaaactgtagccaccctactgatctattgaatcctaggtcttatttttcctgtcaaactgtatgtttatacccattcatcaacctctctttgtcctccccccacacttcctggcctctggtaccactaatatactctctatcttcatgtgatccactt

SEQ ID NO: 92722 - DNA, 260 bp, Homo sapiens
gggcaccaagatgctataagatggagaaaaactaatccatactttttctagacaatattgacctatagattattcagaagggggacatgctgcagaaatgtgcagcgctttaccaattcgcatgtaacacaaaaagttccaagataggcttgtttgcagctctccatgagattatagtctgtgcaatacgatgatgagaattttgaaatactgatagaactttatcaggtatttatgataaaatacagcattgtggagaa

SEQ ID NO: 92723 - DNA, 626 bp, Homo sapiens
caaaccatatttacgtcagtctttactgtctgtctcaaacactttcacatccattattccattaatctctcacatgaggagcccatggaaataattactattgctgcattacagagagggaaaccaggctccgagaattcgaaacactttcctaagagcactgttcagtcagcaagagattcctgccctgaccccagaacccaagtgctcctaagagaacagcactccacttgaaagatacaagataatcacagctgagattagagaagccaaaacataataaaggataatattataaaaacaatgacagtcctttcctgtgcatggttatctctggaaacataatcaggaataacttttgtctctggccaaagaagaagttaggaaagacttactattcttttgtttaaaatttataccatgcacatatattacttattcaacaaataaggttttcaaaagttgccaaactaagatgatcaagtgaaagcaactcccaccagtaagaattgcctctctctcaggaaagatttcacatagctccaatggttctcaaggaaaagagagccaggtagagcgagagacaggtagagcgagagacagtaaagcgaaggcaaggtaagcga

SEQ ID NO: 92724 - DNA, 455 bp, Homo sapiens
ctacatggattatgtctttatttggcagcaatgcaaataatacctgaggcagatacctctctccaagacacaaaaaaaatttaataactttcttaaggtcagagcctagcatcttaaccactccaccatactggctgttccctttccatgacaaaaaacccaacctggccggacgtggtgactcatgcctgcgatcctggcactttgggaggccaagacgggtggatcatttgaggtcaggagtttgagaccagcctggccagcatggcgaaaccccatctctactaaaaatacaaaaattagctgggtgtggtggtgtgtgcttgtaatcccagctactcaggaggctgaggcatgagattcgcttgaaccggagaggcagaggctgcaatgagccgagatcatgccactgcactccagtctgagcaacacagcgagattgtctcaaaaaaaag

SEQ ID NO: 92725 - DNA, 464 bp, Homo sapiens
aaaatacatatgtaaatgttgactacttatatatattgagaacacagattattcactcaccccatacgccctgtgtcattaacaaagactgatagtgctctattgtattggatatgtaaaagagacaggcagcagaatgtttttatgattcaaaaatacattaaagaagataattgtgttagaaagtgcaagattacttgaaaaaagataactgtgaaattgtactcaataagaaacaaaaattatatagtgcgatctattacaatatttacagtataaaagtggagtactttgtactatgtattagatgggaggtattaaatattctttattttcacaagggaacctgtctgtctttatatagaagtaagtgctcagttacagggacaggttaatattgagaggtgtttttaattaaaaacaccactgcttttggctagtaaattatctgtgactcttttagt

SEQ ID NO: 92726 - DNA, 390 bp, Homo sapiens
cggaagattgactctccggaagattggaccgtcgccgtgaagattggacctctccggatgattgtacctctttggccgttgattgtctttgcatcctgagtgggactatctcacggcgtcatacgttctgaccgaaagagtgacatgatctcagttacattttagtaaggccaccgtggctgccagaatagactgaatggcagggattgggaggtcgggatgggaaggaccaaaatacaatcacagagaactgctgcagctgcagagagctgttgcagtgatccaggggaggaatggtagtagctggcatcaggatgctagcaggagaggtggagaaaagaggttggattccggatatattttgaatatagagataacaggaacagaggt

SEQ ID NO: 92727 - DNA, 176 bp, Homo sapiens
tccatccacccatcccccatacatcttcattcatccatcctcctcatccatcttgaggtaaaaatgtgaggcctgggaaggctgttgaaagggctgttttgggagtcagaagccctgagttttagtccaggctcctctcacatatagactgtttgaccttgtaagtcacctcccca

SEQ ID NO: 92728 - DNA, 261 bp, Homo sapiens
gataaagagcagagctgggggtgaaaattcccaagaacgaagaagtagaaggacgtggggaggaaaggcccacttcgcccatcccctctaggttttgcttggagctgtggctggtttgaccatgcctcagaggtcaggccctcagccccccgactggctttggggccaatctcaatgccacctccagggtagacttgacctgcgtgcccccatctaccctggccctgatctccctttccccagccctaccctcatagacgg

SEQ ID NO: 92729 - DNA, 1589 bp, Homo sapiens
  misc_feature (785)..(785): n is a, c, g, or t
tctcttgcaaaagaaacctagtgatgggcagtccagggttggcttggcagttccacagtcatcagagactcttgattccttctatctcggagtcatatattggtcctgcatggcttttggaactcctgccctcgcatctgctgctgagtcagcccccttaaggagctttcttggaagccacaccctgaatggctcctacttaaatctcaccagccactccaagctgcaaaactggctggggaattacatgacttagctgagtattttgttgcttagaataaagttgggctttaagtaaagaagaattgaagaatggttattgggatgggcaatgaacagccatttgtactctcattaagttatggaaattcccattccaaatcgtgcagtttggtgggaatgcctgatagcagttgtaggcagttcctttttttgtgagatagctgattcatattttcagtcagccatcctcagagtgtggggaatgtttcctctcagggtcacagggtgatctcagcaattctaggtgttatgtgcagatatgatttccagggaagaatcatcaggctatttctcctgagtctctcctcttattagggaggaatagctttcccagaaacatgtgccagctctctccactcccaacttcccttaccttccatctgccaggattaagtcccatgttcatggctaaaacaacaaatggtcagtggaaggaaatcatgatgattggatttgaccgtggagcctggaaggggtgactttctctgagatgaaggtgaatngctccacaaaattagggttccaatacacagagggaggagggaagaatggatgttaagtaggtagccaatagtttgatatgtatatatattatatatatgaatatatataatttaaaaatgttttttgtttaagatctttgttgatactatgaataaatatctcattatgcaacataaacatgtttaaaattatgaaaataacatgtgtatggtaaaaataattcagtactaaaaggataaataatgaaaggtgaatctttgttcaacccaagatcctagtttcactccttaaaggcaatccttatcaagagcttttgtgtatttgtctagaaaatattcatgtttatgtaattgttttgacacaaatatgtgcatattagacacattgtactacatcttgctttttaaaagttaatagatatattttggagtttttaaaatatcagtatgtaaagatggacagcacccttatttatgactttgggacattgcatagtacagatataccatgatttatttaataattagcctattaatagatatatagatatttaggttgttttcatttctgaaaaaataactactaacattagagacctccttgggcatggttatgggtattggatacattcttgggagtagaattaagtcacaggatatgtacattttacattttgctagttctagccaacttaccttcacaagggctgtactaatttgggcttccactagtagttacagagagggcattgagattcctaatgctggtcagtcaatggctcacatcttagcaaatatctgcag

SEQ ID NO: 92730 - DNA, 123 bp, Homo sapiens
tcagctgagctgtggcctctgtgggcgagcagggcggacactgggcagcaccagagccaagaggacagctgtaggggcggggaaactgactgactacccctgtatctactcctgaggaccctt

SEQ ID NO: 92731 - DNA, 213 bp, Homo sapiens
cttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccg

SEQ ID NO: 92732 - DNA, 1491 bp, Homo sapiens
  misc_feature (27)..(27): n is a, c, g, or t
cgagcgcagtgtctgggattcggcttntggcaatccacgcatggcactgagccaccttctcagacatggaagcagcctccttgtctagaactagttgtcctgatgatatacagactctaaggaagataaaagtccctttattctaccacaccaagccctgtcctgggcctgctgggccacaccctgcaacccagtgctttccctcagatttattttgttttagctccacagctgccccctgaattcattcagctactgtttcctttaccaaaacttgctccaggcagcagatctaaaagatcagcttacttactactccactgttatttactctaatgtggattaaagtcagcactgtttatcccagaggtatttacatttggagattctggtttggtgaggaaattaccagagaactattaaagacttggatgctcttctcggctttgctattaagtaagttggacaagttgtttggcttctttgagcctctgttttctccattctaaaattctaaaatgggagtgttgaattagatcagtggctttcgaactttctgctcctagtagtgagaaatacattttactccactccctggtatgtacacgcattcctgtgttttgtgaaaacctgacaccatgctcctccctcactacatgtaaaacacttttattcattaaaaagaaaactgactggcttggacctacaaattagtttcattatttgttaatgtttgaaagccattaaaagatgaatattaaggtttctttatactcaatacttgtagttttgtttgggggaatgagaggatgcccttggtacctttgtgaggcctctccactgagggtcaatcatgacttctgttttaaaccagcccatcccatcttctccagctgctctccttatgtcttgcttctctcccctccaaccttctcagcataaggactcaatcctaggctcctaccccagacgggtgccttccaacgttcctggtgccagtggccccccatcagccatgttcccccagccccttctccacactcttgtcacccagggccccatccttcagtgcattgcacactttgcatgctgggtcagggaagattgtggagagaggacagtgcacctggtttcccccacatagactgcgtgggggtatgtcctgcttccgccacttccaactgtggcacttgggcacgcccctctcagggcaccttccctttttgtctccgcaaaatgaggttgtaatagtgcctgccgcactgtctggcacacagtaagctctcaagaaatgttagctgttgttgccgttagaacaccatagctagaataccatacctggcattcacttaaaaaaaaaaaaaaccaacttagggccaggcgcagtggctcacgcctgtacttccagcactttgggaggccaagacaggcagagcacctgaggccaggagttcaagaacaggctggccttgtctctactaaaaatacaaa

SEQ ID NO: 92733 - DNA, 454 bp, Homo sapiens
  misc_feature (424)..(424): n is a, c, g, or t
ggacgacgatcctctgtgcaaatgcccccccccacgcgctccctgcctcccccgccctcctctccggggtttcgccgttcctcctgcaggcgctcagacgtagttaaatgtggccttaaggactaaccgatcgctctggtgtttgctctttcggcggaagtgatagagtaaggggaacattaaacatgaggttcttttggcgggggtgaggggtgtcgcgcacgcgactctagtggccctgactgaagccaaggacagcagcctgttccccgggagggaagagttgtcgatccgttggggaaacgccctcccgggctgggctctccgggaagaggtatttacatttggagattctggtttggtgaggaaattaccagagaactattaaagacttggatgctcttctcggctttgctattaaatntcttcagggaccatgcatctggaggaagga

SEQ ID NO: 92734 - DNA, 871 bp, Homo sapiens
taaatttattcaattccaacgtataaataactctgtaaagacattttatcagtttccctgggctgggatatttttagcatatcaaaggaaaacaaaaaagtcctcagattttgaaaagtaatggattgcattgccttaaacccttggaccctgtccaccttctgtctttgaactgaactggaattattcctctgtttgtgctagaatgtgtgtccgcagagctgggaagagatggagatacatatcccacctcttataatgtgaggccctaacctaggttataattaaaagtttgggagcaggatctacaaaggccagctggaaggacaatttcttagtaaaagcaaagtgatgtctttggttacaggaggaaagggaaagacaaaacataccaaccagaattggcggtctgggcctacccagtcctatatacagtagttccttcttatccacgggggatacattccaaaacctctagtggttgcctgaaacctgggagagtactaaaccttatatatactgttttctcttaagcatgtatacctatgatcattcaatttataaattaggcacagtaggagattaacagcaataactaataactaataatatcaattataaaaatatgccagcatcactactcttgtgctctgaggccactaagtaaaataagggttacctaaccacaggtactgtgataccgtgacagtcaatctgataaccaagacagctattgagtaacaggcacatagtgtccacagcatgggtatgctggacgaagggatgatttatatcccgggagggatggagtgggacagtgtgagatttcatcatgatactcagaatggcacacaatctaaaacgtagttct

SEQ ID NO: 92735 - DNA, 891 bp, Homo sapiens
ggggaagatgccctggatgtgggtaggcactgtccaatcagctggagagaatcctaaagaaaaaggcagaggaaaggtgattatcccgctctctctcctggagttaggacacacttctgcccttggtcatcagaactccaagctctctggcctgtggactccaggactcacaccagaaccatcccccagcccccaccaccccactggattcccagacattgagcctgggactgagagttacatatgggcttccctgggtctccaacttgcacacggcttattgtgggactttgcaggcttcataatcatgtgatccagttcccctaataagtctcttctcacatatctctgtctgtagctagatattgatatcctactggtttttttctggagaaccccagcaaaaacaccatccattgattcaattgctaatctcttccagaaacaccttcacagactcacccaaaaatgctttactagctatctgggtgtcccttaatccagtcaagttgacacataaaattatccattgcaaggtgagacaacaaccctggcttacaccttgtttgcaggcttgttccagggccagaatcagaggactcagccccactgggcctggattcctgacccacataaactgtgagataaatgtgtcatgttttaagatgctaaatttgtggcgatgtgttacacagcagtagatggataatacggactgccttctctaagaacctgctgctcaactctctgtgcaagtctttattcttcaagatttctccaaactttccttctatacagggttgactgagaaagtctttcaatggatgacagcaccttggaagagggaaaactgcataaattctacttcatcaacacaccaacagtccactc

SEQ ID NO: 92736 - DNA, 310 bp, Homo sapiens
gacatatttttagttttaatatcaataaatcaatagaaactaaattttatccttttataacaaatctttattgttaaaatagagtaagctaactacctgaggctatttgtggaataatttatttgtaagtttttaaatgtatcccattgttttcgaagctagtccccagattataattattccagctgacccacaggacattcttctctggcagtttccacccaacctactgatgctttcttcaccaggttggccccttcaacaagtttctgatggtttatacaagtgaagtgttcctaaaaagaaacaa

SEQ ID NO: 92737 - DNA, 315 bp, Homo sapiens
aacatacatgcactcggtgcttaaaaaaaagatctttctggtgaaataaaaacaaaatataaaaacaaggactattaaaggggtctattagaacagcaaggtttagggggcctcgtgtacaagactgcgcatgaccgccatcctgacgggactctcaccatgagtcaggaaatggcttcatggtttctggtctggggctcagttacttaggagttgcatagatccaaataccatctttgcacatggagaaaatggctcataagctgaaggaaggatattatatgaaactctcttgcaactgagtttctgtaacct

SEQ ID NO: 92738 - DNA, 852 bp, Homo sapiens
ctgcccgcctcggcctctcaaagtgctgggattacaggcgtgagccaccgcacctggccttttgtccatatgtgttttgtcctcagtagattcctagtagaatatgaaaataatttgcagaagatatcctagaaagttagagctaaaagggaccttaaagatcatctagtctagagatggcaaataagtttcgattgtcctgctatctatggtttgttagttggctgcctggaggcttgtattgaagattctgggccatgaaggcatcaaaggctaaatcgattagtgatgtctgccatgagcatggcatgaaggcaaggaagtgtgcatgctgcacattttctgtccctagtttctcccttttgaccaatgaaatcacctgagacagaggtggcactagaaatcacgtctttattctaagtccaggactctttgtaaccccatcttgctgaagtaattatttttcttccaactataaacgttagtaaactagagcaccaaaacaatatgcttcttctagatttgccattgagttcactgtaaagtgaaatacaaaaccaagaatcagtccccctcttcattatttttcccaacttctgatatagttgaggaacgaggcctattctatactgggacctacccaaatttttcttgtttatacttagccatattatcatgatttggttttttttaattaagactgttttggtaagacatattctccagcaaattcattttccctgggtccttctttggttaagcatgttgctagctatagccaaaccaacaggtctaagatgcctaagttatattatcttttcttttcttctttcctttctttctttttttttc

SEQ ID NO: 92739 - DNA, 722 bp, Homo sapiens
ggtgaccagaatgtcagtgcagttggcagctgagggtgtttgtgtgacctgaggtcaccctttgtaagaggctccctggggcctgcatggtacatcctcccctctcctgggggaacccagcatggcccaggatttgtggattgcttagaaagatccttttgggcagcctgaagactggggagggttttcctccctcctccacctccacccacattccacttaccctttccctcctcatcccagttggtaacattcccacctgattagtgtggggagttgctgctgcagctgagttctggttttgcccagcaggatcacacacgtgcggccaggaggctggcaggtggaatcagggtgtgcaggggtgcagcccaagtccttttctgctggaaaatgggctgggtgacttcacttgcgtttttttggtatgtagtgggagtaggtccccattcttcccccttgccctttgctttggggtttctaccctaaaaattgaccacggaaaagtgaaaacaagcatgagtagatcctgcttccaatgggggccttcccgtctgcttactgcttaggtttctgcggtgggtctgagcaatgcagaaagtttcttacaatttctctggattgaaacaagaaatagctccctcgctcctcttcataaatttctcagagaaaatctaagttaccaggaagtagccaaagaccaggagattgtggaatcaaaa

SEQ ID NO: 92740 - DNA, 555 bp, Homo sapiens
gaggatctccgggcaaagctcctacacacacacacacacacacacattgaaagctgaaaagcaaatagagtgtggcaaatgacatagcttacttaagaaagccaaatcttaacttggctatgaagaaggctaaaaatgaagctgacctttaccacagaatctttaaatagctcaggaattgagccagacatatgtggtagcagatccccaggtctcctcctcttccccattccactgaacaactgttcttcctacctatacctccaccttagtataagactccaagtatactctttggagggaaaaaaaaaagcccaagtatctttggattgggagatactaggcaaaattgagaacagggcattttaccacatatgagggaattaggtgaatatgtgcacgctgaatgatgggactcctccacctttcttctctcacttgcctttaccctacaggcaggagattagtagaataccccttggtgtatttagcccaagaagaaagatctaagaataccaactttcccaagattagtggacatctgaagaaaagcct

SEQ ID NO: 92741 - DNA, 273 bp, Homo sapiens
cacaaatatagtttactttgtccactttattttgaagaaaaatctctctcttcccataattttctacttggagagaaatagctaacaactagaagaagcaaaactacatcctacattttcttctgaggtcaaacccactgagcaactgaagttggtattattgggttttcatgtgattacttgtcttctcatgtgaaacatgaatacacaaaagggagaatgggttcagcttcctgtaatggccaagtgtctcctttcagagcaatccttgta

SEQ ID NO: 92742 - DNA, 339 bp, Homo sapiens
agaagcatgggagtaggaagggcaaaaaatgtggccatagaatgcatatggccgttcatttctttcactggcttataatcatgatagattcctccctctttccatttggagtcgtgggcaggggtttagcacccccatttttctcccttcctttttctgctctccccacaggcagtgggatgcgagccagcttacataaggcaaggagcccacattgttgccaagatttttaaaaacttttttcttgttaagactgtctaaagtgaagataatgaacactcagctcaagtaaacttttttcacacaaggaacatattgacagtcaatcatgtgattaga

SEQ ID NO: 92743 - DNA, 474 bp, Homo sapiens
gtgtctcctaggtatctgggtgagattttctaggatgaattcctagcaatggaatgctgggtcatatctccatcttgtagtttttgccctggttcgatgagaaggattggacgtagattattctccaggacttaggttttgtgtggactagtgggttactgggtgttaatcacatttaaaaaataaattaattaactgagtaattcacaaaataacaaaggaccataatggctccataatgccagggtgttgtaatctaacaattatacttcatctacctccacatgactgagctacaaaggaaaagaagaaatagaaatcatattgatgtcctgtttgtaatcctgaagttgggtacttagttggagcgacacaggcaacccacctaaggcatggcttttctcccaacttggaaaacttgtcttatgtcccccacttagctttccaaagggggtctatacgttttcctcccac

SEQ ID NO: 92744 - DNA, 382 bp, Homo sapiens
ttgggaccaaggtcagaggactgtacgcacagagaggaggccacagggcttgcttccttacacacttggccctagggcctattccagctctgtgcccatcaccaaggtaacctgtaccctatgacaggcccaggggactcctagcagaacaagcagggggggcctttgggcagtcatttccttggattgctgggaatctggaaatctgggtgacactgaggctgggccttttcaatggaaggccctcacggtgcacagtgagttgccagggtatggctgggactggggtagctagagagccctcaagtgtcagagtaggtcccagggttgggtcgtctctgtcatcagacctcctgttcctgcgagcagcctcaccccctaa

SEQ ID NO: 92745 - DNA, 5044 bp, Homo sapiens
aaaaaagcagcagaacctggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgaccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatgcttagtctttttatgacataatttgaaattacctatatatttcattctattcaattttcaaatgtggtcatgatccactaaatttatttcatggtatactagtgggtagtaacccaaagtttgaaaaccacttttctcagacatataaaagcataccagatgttgaacattgatagtatcaaaagatagtcccttagggttctaattttaaaaaaattttcaaagcattgtaggggagtagctttgtctcatgttaaatcactcttacctttaaggatctgacacactatgtaagaaaaagacttcaaggttggaggaggagattttccatgacttttatcaaagtctacagtctatgttgtgggagaaaaatgtagaataacaaaatgagtaaaagtatagaggcaaaacaagcatgtgtatgagagagagagagaaagcatggaaaagaggaaattcatggggatgagcaaaatgactacttccagtgccacagactagactcagttgcttctcttatgttattttttgagacaaggtcctgttctgtcacccaggctggagtgcagtggtgtgatctccactcactgtgatctccactcactgcaacctccacctcctgggctcaagtgatcctcccacctcagcctccctagtacccaggactacaggcccaggccaccacacccactaatttttgcatatttagtagagacgaggtttcatcatattgcccagactggtctcgaattcctgagctcaagcagtctgcctgcctcagcctcccaaagtgctatgattacaggtatgagcacctggcctcaactacttcttgaagatattttaaaactttatcttaacattgtagagggactgggtattagtcagttgataatgccaagaagtgcaatctcttttaatagcatatctaagacaacctaatgtttatacttctgactcagatttcactactggttctgttgagctttgtcaactgagtaattattcttttcttttttctttctttgtttatgttttagagacagggtcttagtcacctaggctggagtgcagtggtgcaatcatagctcactgaagccttgacctcctgggctcaagcaatcctcctgacgcagcatcccaagtagccgggaccacaggcacatgccaccccccacagctatttttgtttgtttgtttgttttttgttttgttttgtttttgaggcagagtctcactctgtcacccaggctggagtgcagtggcgcgatctcggctcactgcaagctccgcctcctgggttcccgccattctcctgcctcagtctcccgagtagcacccccagctattttaaaaaaaatttttgtagagatgggttctcatcatgtcgcccaggctgttgaacttctggcctccaaaggtgggagttattctagcagcttccctgtgatcttctcatatctactggtggagtgggaaagagtagttcaaacaactcagacagaaaatctcgctggtgcaacagtggagagaagggccaagtacttgtcctgttact

SEQ ID NO: 92746 - DNA, 4060 bp, Homo sapiens
aaaaaagcagcagaacctggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgaccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatgcttagtctttttatgacataatttgaaattacctatatatttcattctattcaattttcaaatgtggtcatgatccactaaatttatttcatggtatactagtgggtagtaacccaaagtttgaaaaccacttttctcagacatataaaagcataccagatgttgaacattgatagtatcaaaagatagtcccttagggttctaattttaaaaaaattttcaaagcattgtaggggagtagctttgtctcatgttaaatcactcttacctttaaggatctgacacactatgtaagaaaaagacttcaaggttggaggaggagattttccatgacttttatcaaagtctacagtctatgttgtgggagaaaaatgtagaataacaaaatgagtaaaagtatagaggcaaaacaagcatgtgtatgagagagagagagaaagcatggaaaagaggaaattcatggggatgagcaaaatgactacttccagtgccacagactagactcagttgcttctcttatgttattttttgagacaaggtcctgttctgtcacccaggctggagtgcagtggtgtgatctccactcactgtgatctccactcactgcaacctccacctcctgggctcaagtgatcctcccaccacatagactgtagactttgataaaagtcatggaaaatctcctcctccaaccttgaagtctttttcttacatagtgtgtcagatccttagtcga

SEQ ID NO: 92747 - DNA, 4222 bp, Homo sapiens
aaaaaagcagcagaacctggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgaccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatgcttagtctttttatgacataatttgaaattacctatatatttcattctattcaattttcaaatgtggtcatgatccactaaatttatttcatggtatactagtgggtagtaacccaaagtttgaaaaccacttttctcagacatataaaagcataccagatgttgaacattgatagtatcaaaagatagtcccttagggttctaattttaaaaaaattttcaaagcattgtaggggagtagctttgtctcatgttaaatcactcttacctttaaggatctgacacactatgtaagaaaaagacttcaaggttggaggaggagattttccatgacttttatcaaagtctacagtctatgttgtgggagaaaaatgtagaataacaaaatgagtaaaagtatagaggcaaaacaagcatgtgtatgagagagagagagaaagcatggaaaagaggaaattcatggggatgagcaaaatgactacttccagtgccacagactagactcagttgcttctcttatgttattttttgagacaaggtcctgttctgtcacccaggctggagtgcagtggtgtgatctccactcactgtgatctccactcactgcaacctccacctcctgggctcaagtgatcctcccaccacatagactgtagactttgataaaagtcatggaaaatctcctcctccaaccttgaagtctttttcttacatagtgtgtcagatccttagtcga

SEQ ID NO: 92748 - DNA, 2746 bp, Homo sapiens
gcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctggaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactgagatagagaaatgttatccaagattttaaagaggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaataatg

SEQ ID NO: 92749 - DNA, 2663 bp, Homo sapiens
gcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctggaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcagagatagagaaatgttatccaagattttaaagaggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaataatg

SEQ ID NO: 92750 - DNA, 2000 bp, Homo sapiens
gaggttaaataacttgcccaaggacatctagctacctagagaccagacctgagttttggtttcacctctgttacttaagagttgtcaactgatgatagtgctaagagctattattaacagtctgaccctagtttctcactagaaactaggcaagaaggtatctggcaccagcttgtcttaggccagtatagcttaggacagggatcgacagattttttttctttgaggcttttcaggccacatagttctctgtcacatgatgtgtgtgttttgttttgctttgctttcttttcttaaatccctttaaaactgtaacaataatttttagctacaaaaacaagctgtgggctggatttggcccatggcccatagtttgccatttctgatctagtatgtcagttcctttgagctttagctgtcttctaacaggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaataatg

SEQ ID NO: 92751 - DNA, 1918 bp, Homo sapiens
ccatttacttggtttgaaaaccctgtttttattgtgaattcactaagaaatactctacttaaactagcagaaatttgataacctttgaggccttatggacttaccaaggtagaactttttgggtaaaagctggatctctatacttttttggattgggatatcttttgcttattttgagtttgtttcaattaccttagcttcagaaagtattaaaatgccaatgtgggtcacatccttttaaagggatatatatctagtcaaggttgtttggattcctcagacagggttcttaactggacctaagaagacttaaaggaagaaatctcattaaaaatgaaagcataataaaagtttgaatatattattagatgtgctgcttagggtttttgatagtttgcttattttttgtttttgttttttagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaataatg

SEQ ID NO: 92752 - DNA, 421 bp, Homo sapiens
cagctggactctactggcagacctttggtaatcaagtttgtacctgtccctgggggaggccagggaaggaacatgactgtgtccttgtcttgggttgaacagccatctgctttgcttcaggagcctctgagtttcccatcctcctgtgaggaggccccagggttgcagttccatgcctagtgtcatagcaatccagttgtactgtatgttggagcagtcctgtgtctaagaaagggtggaagctgcattccagggttgactagatatgcagtgtcagtatggggaatttgttctataataggcagttaatttgtatagcttcatgccagcttttttttttattcttccaggtgatactgccccagcgtaaatttcagttgcaccatttaaagctttctgaagatgaagagactgtttacaa

SEQ ID NO: 92753 - DNA, 2713 bp, Homo sapiens
gcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctggaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaataatg

SEQ ID NO: 92754 - DNA, 2082 bp, Homo sapiens
gcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctggaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctgctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaataatg

SEQ ID NO: 92755 - DNA, 121 bp, Homo sapiens
ctgagatcacgctactacactccagcctgggcgacagagtgagacttcatctcaaaaaaaataataaaaagagtaattccttaatattatctaccactcagtcaatagttaaattttccca

SEQ ID NO: 92756 - DNA, 1169 bp, Homo sapiens
gttgcttccaaatcttggctgttgtgaatagtgctgcagtaaacatgagagtgcagatatctcttccacatactgattccatttcctttggatatattcccagtagtgagattgctggatcatatggtagttccattaattactgctaaaagctaaacatcagatttttatacatatagatggcatacattcatcagaaatatatcgtgcttcataaatacttgtacttttggctgcacattataatgtagtatggcatagtattgagtaatagcatatcaatttattctttctgtttaaaaaccaaatacattaatctggacaaggtagtgtgtgcctgtaatcccagctactcaagaggctgatgtagaaggaccacttgagcccaagtgttcaagacgagcctgaacaacatagcaagacctagtctaaaaacaaaaagatacattaaatatactacatcttattcatttgaattaaaaagtgaaagctggacatagtagctcacacctgtaatcccagcactttgggaggccaaaggtgggaggatcacttgaggtcaggagttcgagaccagcctggccaacatggtgaaaccccatctctactaaaaatacaaaaattagctggacatggtggcgggtgcttgtaatcccagctactcaggaggctgaggcaggagaattgcttgaacccaagaggcagaggttacagtgagccaagattgtaccactgcactccagactgggcaacagagcgggactgggaaaaaaaaaagttatctttctaggagaaaatctgctttggttggttcaacagtaagaactgactttgccagttaagctgtggtagatatgttcactaaattggatgcactaaatctatagccataatttgaggaaattgagttgacaactgatacattaaaaatggatatcattaaaaatggattttaataatcaaacagtgtatgacttttggcatataacttgtaaggagctcaaagactcaaggggagacattactataacatttctcacaagttagtaatgtgaaaagggcttcttagcatttctatattaaaaaaaaaagcaacacccaaaatagaaaatagacctagaattaatattgaacctgagtcttctagtggaaagccatattgatgcatg

SEQ ID NO: 92757 - DNA, 423 bp, Homo sapiens
attgaccttacagtgtccttgtaggactcaaaagagatgatgtgtgtaatgctcattacatagtttgtcatgtagcaactgttcagttaccatcatcatcatgattaacaatagtagtcgcacactgtttaacacaggaaaatagctctcagcaacaaaggaaaatagatccaacggcctgatttttggaagttaattatactcattctgattacttatgcatttgttttcttgtgaaaaagagtggtgacacagaaaaccctgaagttttcacgggttaaggtgcctgagataataagtaatatacagaaatacctagatgatgacattttccataaaaattggcttcaagaacattaaaataaatgtccaattgcagaatgtcaatctgcctgacagtgtaaatctccttaaagcaattta

SEQ ID NO: 92758 - DNA, 458 bp, Homo sapiens
aactcctggcctcaaggaattcttctgcctccacctcccaaagtgttgggattacaggcatgagtcactgcacctagcctcacttatgttctatttacctttaccactgttgcactttcagcattttcaaagtcctctcaaaataatggtttcctttgcttctccaaacagacttaagtaataggttatacattctactttaagatgagagaattactttgttttaagatgggggaatttattgtgtaacagagaataaatcagtcttagacctgaggccagaaatctctgattttcttgacttcagatcacttaccactcccaccctctgtcctgcccccagcttcaatcatggaagaaacagaatgtaaatgatagctgtgtctcaaaccatctttcagaaagctgaccagaaatataagtcacattgtttataaagtgccgatggagtttatcca

SEQ ID NO: 92759 - DNA, 765 bp, Homo sapiens
cttgaaacgctctcccctccctgcctcccaggcaatgcccactctgcctccaaagttcatccatcgtcctctcctcaggaagatttccctggtggcttgactaggtcacagtccccctttatttgccgtcttctcactggggcctctccttcctggtagcttctaaacaaggcagtttcatgtgtgtatctccactagactagacgctctctgagggcagggaccctgcttcgcttctggcccgaggtggctgcagggtctgcaagatcatcagggccccctccaatgtgacacttgcagaggggacccctggcctggggccacgctggttacttgggtacactccttgcccagggttccacagccccttaaaggcagggtctttctggccacgcctggccctggtctggcctccccaaggagccctgccgctgggggtgctgtgtgggaacagagcacaggccctccctcccagagcccacgagatctcactttctccaagcccagctccccaaggactcagaccccagttgccctgcactgaacgctggcttgccctagctcactcggaccccaccctgcactgggaaggagggtccctgtccccgtttgacgggtgacgacactgaggcccagagagctgaaggggctggccgaggggacgggcttgggcgcttccattctcacactgctgccgtgacacctaatccatccggggaagttccctttaaacccaaaaggggacggtgaagccacacgcggccg

SEQ ID NO: 92760 - DNA, 492 bp, Homo sapiens
ttactgggatgttaaaaaataaaaacctgaaaggtatttacagaacagctaccaacatggaattaaaggaatctcaatcttgttaaatattctaaagagggaagggtttggttacagcatgtaaattaaacttgagacaatggcgggcgggggggtcttgatccgcacacctcttctccagattctgcgggggggaggggtgttaaaatttaaacgcacatggaagaaaaaaaaaatgtattacacaaagacggcaggaaatttcttaaattcgggtgaaggaagcctgattattgaatatcacttaatggcctcattttagaggcagtataaaaacttttctgaaatgctcatgtttttggagtaaggtgaactgggttatttttccccaaccagtaataacagacaaatttgcagtggtatctggggcaaaggtttttgaatttagaccacgaggagagatagaaatctgactttaaggaagtggaagaa

SEQ ID NO: 92761 - DNA, 535 bp, Homo sapiens
ggaagctcctggaggaggaggaagaggaggcatgcgagggggctgatgtgaagtctgtaggggtgaaggggacggtatcgaagacctgaaatacagtgctagctaagtaggggtgggagcagatgaggtgacacgttgtaactccgacggacgacgtgcggaatgtactgggtggaggaggaaaaaaggcccgaggagaggggtgtgtcaagcgaatgaagacggcagtgtgtgcctcagcgcctggtgcgtgcggagctagtgacgggtgggcccggctggggcccgtcattccttcagtgaacatcccatgagctctcgctcggtgttgagccctgtggtaggcacagatgcacccgaccagcacctggagctcaagaagccgcaggaacttaaagaaatggaaaggctgcccttggcaaatgaagataaaacaatatgcattaaatagaaacataacacatcataagtgaactagttcttatcagaaccagtattttctttttttcttttttttttttttttttttgggaaa

SEQ ID NO: 92762 - DNA, 378 bp, Homo sapiens
gatctatgtaagcttggcccactggatgcaaggcgaacaggctctcctcgcaccttcagggcaagcagttaaacagaccagcccctcacacactcactgggcagctgcggtgtggccaagccccgaaaggaacaggacaaagtactgggcgcaggctgcagatcaccacagatgccacgatgtgcccctggatgtccctccagcctccacaccccactgtgcacctcagccaccccagggcctctgcactcaccatcccaacggcctctccacatctgcacaggatcagctcctgcctccaggccacctcctgaggggcctcccatctctccaccccttcaccctgcccctctactgtcctagcacctgccacctctg

SEQ ID NO: 92763 - DNA, 1123 bp, Homo sapiens
caaatctctcgcgtccctgttttttttttttgtcaaaattctcttgattatttttgtgtatgtaggttgactttaagagttttattttggattttgtaagtagtaaaggggttgcattttacaaagccaaaaatacaaatagccccaagaaactactactacgaagatttatttttatttcccatctgctgggtattgttttaagtactttgcagatattgttacagaagaagcagttatactttgatttatttttctttctttcttttttttttttttttttaatggagtctcactctgtcaccaaggctagagtgcacagtagcacagtcttggctcactgcaacctccacctcccaggctcaggcagtccttccacctcagcctcctgaattgctgggactaccaccatgcctggctaatttttgtatttttagtagagacggggttttgcgatgttgcccaggcttgtcttgaactcctgagctcaagtgatctgtccatctcagcctcccaaagtgctgggattacaggcatgagccactgtgcccagcctatattttgatttcatagtgagcaaaaaattggtctgattgcatgactgtagtggggaaatgataataagctgacacctatgtgttttagctgagacagtataaaattgtgtctagtatagatttgaggtgtactgaggttccacttgcccctcaagggacacccccaattctcatatacccaccttgaacacagttaacagtgtttgtgtcctgctttttataagtcatgagcatttcctgatatcatcaaaatgcttttagaaatacaactaataaatatattgtgtcttgcctgttgtattgttgcgaaatctagttattcctacaggcattgtatttttttggtggtatctttcttttgcagttgtgttgtatgtgaaagagtatgtcacctgtgaggtatggagcctcctaaagagacctgggagccagctaacttcagccggagcctaatactcatgcattgaactgtgtgctctttccctcaggcctttaattacaggtacacagttacaagtaatactgtgacctactcttcaatcaccctttcctttttaagagaatta

SEQ ID NO: 92764 - DNA, 382 bp, Homo sapiens
tatactatccttcctcttcatcatcagtgtgaaaatgttccaaggtggaaagaaccagagcccacacttatcccattgttaccctgatgcttccgagctcccctttttaccatggggattgcttaagagaactcaggtgtcttccagcatagttccacgttctccaaccatcgctccagtgaccctttgacctgggtttgagccccacatatgggcaccacttgctgagagcagctcagtcgtggagaccctaacctagtggcactagtggaattaaaaacacacacagaaatatatagtgtggagtgggaaatcaggggcctgacagcattcagcgctgaaagccatgaacagagatttacccaggtatttattgacagca

SEQ ID NO: 92765 - DNA, 117 bp, Homo sapiens
gatcagcacaggaagagccttcctaagcatgtggtcccagggaagggtgaaaagtaggagttatgaacgtaatccacctactacaatgttgaattaaagttataatctcataacttc

SEQ ID NO: 92766 - DNA, 641 bp, Homo sapiens
gagtagctgggactaaagggacgtgccaccatgcccggctaatttttgtattttttgtagagatggggtttcaccatgttggccaggctggtcttgaactcctgacttcaggtgatccacccacctcggcctcccaaagtgctgagattacaggcgtgagccactgtgcccagtctgttttgttttgtttttttaaactgattattaaatcatttaatttcatattggtctgtgtaaatatatttgcaagtgaactttgggtacagttttgctccagtagcattagacaagatgagtccaaatgagattgtcttcattgtgcacttacgaatcactctcctctggccggctgcctctccacactgcagagcaggcctgcagagttggggagccatggtggttgagttccccaagtggcccaggcctcagactgcctctgcataaaagggtgtctgggagaagccgatctaaagcagtaactcggccctatgttaagtcacaaaatatctaaccattacatgcatggtagaaactggtatcttccctgtttctggaaaggaatctgggcagacccaggccgcaaatagtaacgattgggttatctatgctttcagcgatgccatcagaagaaatagtaacac

SEQ ID NO: 92767 - DNA, 274 bp, Homo sapiens
ggaacatcaagggatgcccccccattcttagggatggtgaccttcctcaccaaatcctccattgacaatgtgggattcacctccaatccctgagagccttgccccaggcagtcacgggcttgtctggtccttggagcggagctggttaggcaggggtcagcctgagaaccacgtaggggtggggtgcaggaggcggcaggacatggtggtggtggtccttggtatgaaaccatgtgcttccaggagcagcgagtcagaagccgggccaggacca

SEQ ID NO: 92768 - DNA, 220 bp, Homo sapiens
gaattttctagttatgttttctttttaaaaaaaaaaattaacaaaagttgtatgtattcaaggagtacaacataattctttgatatatgtatgtgtactgattaaaaatatggaatacttcacaaatttgcatgtcatccttgtgcagggaccatgctaatcttctctgtattattctgattttagtatatgtgctgtcaaagcaagcaatttaatttct

SEQ ID NO: 92769 - DNA, 508 bp, Homo sapiens
gaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaa

SEQ ID NO: 92770 - DNA, 340 bp, Homo sapiens
tatttaagtaccctgattaatcatttctgtagatacacactcttatctgactgcattctagaaagtattgaattggtttcacattctcttttaaaaaaagaaggttaatgggaagatgggaaacgcccttagttctcatgcaaaagggaaaacactggaatgcaaagttttgacccaaaccacagctatgaagccagcatcgggatgctttcaaagctaagcattgctggggtaactttcataatataaaatgtctggaccatctcattaccaatgagaattgcattctttaaagatgatttgaacaacatttgctactctgcttgtcatctataccatg

SEQ ID NO: 92771 - DNA, 148 bp, Homo sapiens
tactatcagtagttttcattagctcctcaaagctatattgcaaagaatttaaatattattatcattttaataaactaggtcagttcacaaaagcaaccaaccacaaaagcactttaaacaaataagactcaccgactgagattaaaag

SEQ ID NO: 92772 - DNA, 359 bp, Homo sapiens
gtcttgtcctttgaggccagaacagttgacatttatccaaattccgccagatgctggagctgatcctacattaggtcttgagtcaagcatgaagacagcagtaaattttttacagactcagcaaaacacaaggcccagttagtaaatacttgctatttcttgctctagttggctttgggaactgagactgtgtcaatgtggcttaaagttttgcctgggaaagataagactgtaaaccaacaaatcactctttgcttcagaaaattcctagagatcaatttacaaagataaaaatattctcatgtgagcaagtatcacttgctaagtaacagtatacttacttaaacaccatccctgta

SEQ ID NO: 92773 - DNA, 389 bp, Homo sapiens
attgaaaagaaaacagatattagcaatcaggctgagattagaaaggaaaaacatatctaaaaatgaaaattataaggtgaataagctagtcaagaagtaatttaggaatatatattagaagttaatactaaaactagacctaggctggaggttaggaaaagtagagaaaggcagtcaggagttcaagaccagcgtggccaacatggtgaaaccccatctctactaaaaatacaaaaaattagccaggcatggtggcacgtccctataatctcagtcacttggtgggctgaggcaagagaatagcttgaacctgggagatagaggctgcagtgagtcgagactgcgccactgcactccagcctggacgacagagtgagactccatctcaa

SEQ ID NO: 92774 - DNA, 547 bp, Homo sapiens
gacagagtgagactctgtctcaaagaaaaaataaataaatgaataatgacaatatgattgtcatgcttaagatactatgggtgttcatattcacatttccccagttgacccaatactgacccttgtagtgctttttttttcttttattgatgcaggatccaatcaggtatcacatattgcatttacttgtgcttctgttgtctccttaaatcgaaaccatttggatagtgtgggttttgtgggattttttgttttgttttcttttatgacatttacattttgaagagatgaggctgttgttttgaaaattcagatttgtttgatcattttgttactgttagattccgtttaaatattattttctggcaagaatacaacatgggtggtggcatgtccttttcagtgtatcacatcaggagatacgtgatgctgctttgtctctttgtcggtaatatataataaaataggatcacttggttaagttgatagcaactggatttcttcatgattttccctttatgtcctgtttccttaacagccttttacc

SEQ ID NO: 92775 - DNA, 334 bp, Homo sapiens
acaattagtgttatgagttattcaacttctttatcagagtaaagtaggaactaaaaaaattttttaactattttgaaaatctaaatataaaacttttttaaagtttctaaatggttatatttcaaaataaaaagatgaaaaattaagtatccacattaagatgttagcaacagaacaacagaataaattcaaagaaaatagaaaatagaaaaaatatagaaaagatgaaagtaaattctattaaactttcaaggataacatcccattcttataaaaagtatcctagaaaataaaatgcaaccattcttttagctcactttatgaaagcaaaatt

SEQ ID NO: 92776 - DNA, 155 bp, Homo sapiens
tcagggagcctttcctaacttgtctgcctcaggctgactgctcttctgctctgtgtctcctccttgcagatgggctctgagtgtacagcattcgtgcaatcaacaaatagtggctgaatgtacactgtgtgcccggtactgtttcaggcactggc

SEQ ID NO: 92777 - DNA, 212 bp, Homo sapiens
ggaatgtttaaatcagaagaggagagatacagctgagcattttccttatgggcaaataaggtcttttccctatgttcttaatctctaaaacttacttttgattttatatagacagcagatagtcgaaagattagaattaatttaatgtatacacttactcatttctaatataaaagccaatcttaatatttgagtttgaatattttttcccc

SEQ ID NO: 92778 - DNA, 361 bp, Homo sapiens
accagcctgatcaacatggagaaaccccatctctactaaaaatacaaaattagccgggcatggtggctcatgcttgtaatcccagctactcgggaggctgaggcaggagaatcgcttgaacccaggaggcaggggttgcagtgagcggcgatcacgccattgcgctccagcctgggcaacaaaagcaaaactctgtctcagaaaagaaaaaaaagaaaacgacatccgtcatcagttttcacagaggccaaatcccagggttataaaagccctagtatgtgggcagttctttcacgctggctattttggtggcttggggacatgtttaggaatccttcatgcttatcagcattaagccact

SEQ ID NO: 92779 - DNA, 457 bp, Homo sapiens
ttaaagagggcagatactttccggatcctggggatttgagaggtcacatgatttctatccattccatcataacttacctgtacaaagtggtaggtaatagggctgagattctggggataaattcagccccttttccaaacctggtgacatccatctaccaagttcaacaaacaaaactccacaattctaacattctctcttttcaaactggaaaaaattatcctcctggttttaataagaggccttgataggcgataaattgtaatgtaatgaaaaagtggatacggagggaatttggggctggaagcaaaacaagtacatattctacacttggataatgaaccaagccaatttattttggttactgtcaaatatggattaaaatgtgggtcacttcctgaacacaccagaaatgaaactgagattggcaccaagttcccaaaacctgatgaagagt

SEQ ID NO: 92780 - DNA, 158 bp, Homo sapiens
ttattagttacagtagttaggctaccatgattaatccaaggaaggagagcttgaactataataatagtaaacaagcattaagatttttatcaggggccaggcacggtggcttacacctgtaatcccagcactttgggaggctgaggtggtgcattact

SEQ ID NO: 92781 - DNA, 365 bp, Homo sapiens
ctacaagcaaaaggaaaagctgccccctggtttggttccttccctgcaagttatcttccaccttttcacttatgtccttcccatttcaaattagatcctaaagtccttcaatcactttcttgcctcaatggattacacctgccttgaaaaccacaaccttggattatggctcaatataatcactgcttgctgccctccactgccctatggatatcttactgagatcattaatgaacactgactgccaaatataacacttttctactaagctctcaaagcaagtaatggaaaaagcaacaatctgatactattgagctctctccccttcataatcactcccctttggggcttcaagggcaccattc

SEQ ID NO: 92782 - DNA, 281 bp, Homo sapiens
agatggagaaggaaaattatcgcgaagtaagctttccttcaagagtagaaaggtaacagatgccagtaaagggaggaaggaatgagtgcaggcagctctggacaacagggaaaggtaggagctgagagtgggtttagtttgggttcatgtctaaatttactaatcatccagtcacagtggttcccatctgtaatcccagcactttgggaagccaaggcagtagaatcacccaggagtccaagaccagcctgggcaacatagcgaggccccatctctatttc

SEQ ID NO: 92783 - DNA, 491 bp, Homo sapiens
ctggaatgttatttgtgaactaggccttgcaccttgtcaatatttttagttcttaaatttctggaatgttctaaagacataaaacatctacttcattttgaaattttgattttaacatttcactaacaacactgggaaaggatcatcttaactaaaggtgtcaagactaacgtttgagcttagccgttgaactttctcttaggggaaacagtttaatccccaagtactatgagataggcgttttaaggcaactttttaaaaaggaaaataaatctgctttttgccgtctaggaaagatacatttttccttgtggaaatctgcagtctgaaaagacagatatgaaaagcatgaactgttgaaaataacctaaatgttctttgaaaatttaaaggccagcttatcctgcaatggtgatagaatagtcggcttacaacacgcaaagccgagccgcgggtgggcaggcgccgcccgtggctcgcggagtggatgc

SEQ ID NO: 92784 - DNA, 505 bp, Homo sapiens
aggggagtggtagacttttccggctgacctaagtcctcaaagatgaataggacttcaccagggaaggcattccaggcagagggagcagcagatgcacagacacaggggcaaggcgcaaggtggggtgtagcgttcagagtctggaaagctgctagaggccagatgatagacagttgtgctaagaagattgggcttaatcctgagggcagatgagtaaaatgttcagattcacattgtagaaaaggtcacccaggtggcactaggaagaatgaattgaagggaagccacattaataggcggaaagaccagtttaaagattgctagaataatcccaatgagaactggtaagagcctaagcccagtggctaaggaaagtaggagacaaattcaagagggcttgggaagtaaaatccacaggacttactggtcagctggatggacgggcgatgtttgggccaatgagaagatggtgttgccacccacctaagtagggatagagaaggaa

SEQ ID NO: 92785 - DNA, 482 bp, Homo sapiens
tacaaaattgacttgtttatatcgatagtgcctctggcatatgttgaccataaaaggaatatgaactaaaaaaataaaatcctaagcctcccgacagactgaatggacccgctcttggccaaacgggatccccaaaaccctgaaaatctatcagggtatggcaggaagtgggcattggacacacctcattgtgcccaccccccgccctttggaatttaggcacaagtgaccaccactaacattaaaatagagattataagaccgacaaaaccgactcttgtaacaacaaaataccaaattataaacaggacctaagaccatgcaggcaggggttaagtgatacatgcctacacttaaagagtaagctggccgggtgcggtggctcacgcctgtaatcccagcactttgggaggccgaggccggtggatcacgaggtcaggagatcgagatcatcttggctaacacagtgaaaccccgtctct

SEQ ID NO: 92786 - DNA, 851 bp, Homo sapiens
caagcagtaagtgtgggatgaatgaagacacaactcacccttggtggcttaatttcacgtctttttctgtttgctgaagtctaaataatattgttaagttgtaccaggcagattccacaggctgtgagtgcagagtgcactgtaaccagaacattcgtcagaacaccttcaaagaccaccacgaacccaatacagatgccaaggcttaaaggagatgaaataatgagctttgccggttccctcgtgttattttgtggagagcagttcggtgatgctggtcaaatttaaaatgtgccttccctttgacccagcaattccgctgctaagaatgtaccctttggagacagagacacgtgtgcaaaggtgaaaatataatttgtgcacgtcttttctctctacaccttatccctctctctcctttcttttagtggatgaccctgcttttcatttcccaaagaaaacagaagcaaccagcagagaaccgcatacccttcagcctgtgttcagcagagcctccttcctttctgaggctccagacccagctcgggcacccctgacctctagtgcccaatttcctccctcctgcctgttggaagacatcactcttttttgcatgatcagttttctgcctttctacctggctattttcatcagtctgtacacctgctgtcattctgctattgaaaaaacctgagtcctctctttacctgacttaaaactttcctcaatatcatcaaattctccactcctctttataaagcaaaacatgaagtgctcatgctcatactcagcgttcccatccttcctgaaagccactcccatcagcctttggtccataccactctctcaag

SEQ ID NO: 92787 - DNA, 603 bp, Homo sapiens
gcaaggattcccaatgctaaccaatgcctcctctcttggcttaagtgacaatgacactaccctctctggccccaccttggctttcttctcccaccatccctgtcaattgtggtatctgcccccttttcaccatccacagtgcctctcagacaggtacttctcccaggcccttagcttcagctacacctgtatccgctgatttccaaatttgcctccaaccagatcttttctgaggtttgaattaaaatatccaacttctctagatgtgtccaaaagaatgtcccccatgggcacttcagactcatctccagacatttccttcaacccagacttgactcgtcccctacatctaatcagaatcgaggtttgctgattttatctcaacatttctggaagccatttgccctttccatttctactgctctcccttaatttaggtcttcaaaattaacttatgttaatgatgacaatagcagtctcataactgacctttcatcatcaataatggctctcctaactcacatccccaaccctcacttcattctccaaatcacttcagggcaacagtttaaaaatggaaatctgattatcattccctcctca

SEQ ID NO: 92788 - DNA, 142 bp, Homo sapiens
gggtgaaatgtcattgagtttcctagattcttccacagcccctcaggattgactatgaagtgtaagctgtgtcatctgatttgtcatggcagtgagcactcccttaccttcgatgatgcctcacgtcaccttttgcataaag

SEQ ID NO: 92789 - DNA, 472 bp, Homo sapiens
tgaatgtggtgttcctgggtggcgccttcatctgcagcatgatcttcaacaaggtggccgtcactctgggtgacgtgtggatcctgctggccacgctgaaggtcctctccctgctttggcttctctactatgtggcaagcaccacccgccgaccacacgccgtgctctaccaagatccccacgcggggcccctctgggtgcggggttccctagtgctcttcggcagctgcaccttctgcctcaacatcttccgagtgggctacgatgtgagccacatccgctgcaagtcacagctggaccttgtcttctctgtcatcgagatggtcttcatcggcgtccaggtgacaggcttctcacgtccccacatcaccgaggacataccctatctacccatgccatgcacacacctcccactacctatgcctaggaacagccacacaggcaaatacctaatgtcccagggtctttgcac

SEQ ID NO: 92790 - DNA, 472 bp, Homo sapiens
ctccaccgcccaccagtgccaggtgcagagggaaggggcggcgcatctcttgggagacaactgctcacgttggaaaagaacctctctagttaaattcgtgccaccctgaagcatttcacacgcactgcagccgctccgctgcctctgcctggctcccgcctcctaacccagcacccaaacaaaggtgggatgcagctcccactggggaccagattgtggaggaggaagcagcttcccagccctaggctgttccaggatccaggtcccttccaagcagaggcaggcatctctgcagccagagatgggcaagggtgggcctgagccagggccagactgcagacgcctgcctccctcctgggtgtgaccccagacgtgcctggcctcaggggtctcctgacaccccgtcctggggggtgaagattaaatgagagcccccacactgtccctcccctccgaagcgcacgctgggacc

SEQ ID NO: 92791 - DNA, 348 bp, Homo sapiens
tgggtggaatacagggaaatcttacatattgtcttgcctgacagttgctttaagtggactccttctcatggttttggagaccaccccatcactgagaatttgtgtctcctagagttcagtctaaaagccgagatcctacattgtgttccagggaagcttaagaaaattaggtctctgcttgatttggaaagcttagactgaacctaaatgaaaatcaggtcagtaaaaagtcagagtttaacaaagatagatgttatgtcccagagaccagacatttaagcattactttcaaagtgcactcagagagatatttgttcttcatttagtacttagagactaagtcttatc

SEQ ID NO: 92792 - DNA, 861 bp, Homo sapiens
tcagctttttcaacatgtctttatttgcttaaattaacaaaatataggttacatgctcttttcaggtaaactgctttttcagtgaagcagaaagcaatattcacaacttgggctgctatatacttagagttttagtttttaaatagcaagccagagttctgtacaaaatcaacatttggtgtaatgttgtccaaatatgcgaaggatttcaaacgttagctctgttatattttgttccagcaaagcagacaaagatcataattcaaaacaccatgttaatattttattaaatgcgttcagggcttaataaatacagtatgcacattgagctttctcatgcaactactcatatacaaatataccagttactcttgtgggtttatgaaaggtcagccttagtctcatggccggtggggagtcaaatttttaaaaagagagacagaaagaggaattgaaaggtaacatgaggagtaatcataggaaagaataaaaagaataaaagaaaaatatgccactttgctggtccattgatttgttcaaagtgacagtggtcaaaaggctggaaagcatttggtagtgacctattttcagagtctcacaatatgatattctggttttggaatgctggtaatcttggaaggcttcatcccttagttctctgagatggcccacatggactctccttcaaggcttgccttctggttcatcagctcattaggcaaggctggccaacccttcccttaactctgtgctcttgcataaagtgtccatgtaatttctcacccaaactggaatacttttgagaattaaggtgacacttgaataattatcctgggacaacaggtctaaaccacgatcatc

SEQ ID NO: 92793 - DNA, 1932 bp, Homo sapiens
cgacaacgtcacccgcagaccggccaatcccgccaggccgcggcccagtggcgccggcgcgcaccgaagacgacaccagccatccggccaatcccgccccgccgcgccccgcaggcccgcccactcctcgcttctccacttcccttctcgaagtgtccggtcgcttctcgcaggcggcgcgcttgctgggtcacagtgaggcggctccgcgcaggcgcagccgggcgggcgaggagcggggaagctgactcagggctgcggccggggtcctgcggggtaggagcgcgaggccggcctgagggaggaggcctagcgacccatccggcgcctcccgccccgggcacccgcccgcggccgcgcatcctgcgggccccaggaggcctccatctcaaaacaacgtgtttttaggcacatgacagccttcttgcaatcaagaaactacgtgtggccaggatctcatccactatcacagtttcagctttccccaaactggaatgtgtctttgcagacgcccatccttattaaagggcaaagacttctcatacacctaggatggatcttatattcttggcgggactgcagagaaggtgccgtgtcctgagtcctcatgtcagggcacaggcttccagccagttctacctgggttatgtttatctcaattccctggtggtattggtgtctgctgggttttgccagaatgaagacaccgtgttttcatttgtcagttgattcgtattttccaggaagacattctgagattacagcattgtcttagtcaaggtgctgcagaaggacagaactaataggatatatgtacatatgaacagaaagttttatgaagaactggctcacaccatcacaaggcaaagtcccatgacaggccatctgcaagctgaggagcgaggaagccagcagtggctcagccggagtccaacaagcctcaaacggaatccgacagttcaggcttcagtctgtggccaaatgcccagagaccccggaaagctactggtgtaagtcccagagccgaaaggccaaagaacctggagtgtgatgtccaagggcaggaggaatggacagaagcatccagcatggggtaaagacgaaagccagaagactcagcaagctagcttacctactttcttctgcctgccttgttctagccgcgctggcagccggttggagggtgcccacccccactgagggtggatcttcctctcctagtccactgactcaaatttcagtctctctgggagcaccatcacaccagaaacaataccagccatctagccacccttcagttcaccatcacaaccattgtcttattcatgaaacttctgcagacccaccttaacctccatcggtgacttctacctgaagccctctgattgttgcccagtggtgctttttaaaataatttccatagtttcttctacacctttagttggcattctactgtaaaggagagattttattttcttactcatttatttgttagtttatagtcaccaccatatggatgcagagttctgtctcattcactgggaagtattctgttgcagtcatgatttattttgatgttcacatgccagatttggtgagtgagcgccccttcacgctggctcccgagtgctgacgtgtccccgtccttctctgcacttttccttacctcctggcctcagatattccagggtcatttgttctctccctgctccaaccctgcagtcagccatctccctagggacgttggttcctttatggaaggtggcatttagaagccaggatttgggctgagcactgtggctcacgcttgtaatcccagcactttgggaggccgaagtgggcggatcgctggaggccaagagtctgagtccagcctggctaacatggtgaaacccttccccgtctctactacaaataaaaaattagctggga

SEQ ID NO: 92794 - DNA, 1888 bp, Homo sapiens
cgacaacgtcacccgcagaccggccaatcccgccaggccgcggcccagtggcgccggcgcgcaccgaagacgacaccagccatccggccaatcccgccccgccgcgccccgcaggcccgcccactcctcgcttctccacttcccttctcgaagtgtccggtcgcttctcgcaggcggcgcgcttgctgggtcacagtgaggcggctccgcgcaggcgcagccgggcgggcgaggagcggggaagctgactcagggctgcggccggggtcctgcggggtaggagcgcgaggccggcctgagggaggaggcctagcgacccatccggcgcctcccgccccgggcacccgcccgcggccgcgcatcctgcgggccccaggaggcctccatctcaaaacaacgtgtttttaggatctcatccactatcacagtttcagctttccccaaactggaatgtgtctttgcagacgcccatccttattaaagggcaaagacttctcatacacctaggatggatcttatattcttggcgggactgcagagaaggtgccgtgtcctgagtcctcatgtcagggcacaggcttccagccagttctacctgggttatgtttatctcaattccctggtggtattggtgtctgctgggttttgccagaatgaagacaccgtgttttcatttgtcagttgattcgtattttccaggaagacattctgagattacagcattgtcttagtcaaggtgctgcagaaggacagaactaataggatatatgtacatatgaacagaaagttttatgaagaactggctcacaccatcacaaggcaaagtcccatgacaggccatctgcaagctgaggagcgaggaagccagcagtggctcagccggagtccaacaagcctcaaacggaatccgacagttcaggcttcagtctgtggccaaatgcccagagaccccggaaagctactggtgtaagtcccagagccgaaaggccaaagaacctggagtgtgatgtccaagggcaggaggaatggacagaagcatccagcatggggtaaagacgaaagccagaagactcagcaagctagcttacctactttcttctgcctgccttgttctagccgcgctggcagccggttggagggtgcccacccccactgagggtggatcttcctctcctagtccactgactcaaatttcagtctctctgggagcaccatcacaccagaaacaataccagccatctagccacccttcagttcaccatcacaaccattgtcttattcatgaaacttctgcagacccaccttaacctccatcggtgacttctacctgaagccctctgattgttgcccagtggtgctttttaaaataatttccatagtttcttctacacctttagttggcattctactgtaaaggagagattttattttcttactcatttatttgttagtttatagtcaccaccatatggatgcagagttctgtctcattcactgggaagtattctgttgcagtcatgatttattttgatgttcacatgccagatttggtgagtgagcgccccttcacgctggctcccgagtgctgacgtgtccccgtccttctctgcacttttccttacctcctggcctcagatattccagggtcatttgttctctccctgctccaaccctgcagtcagccatctccctagggacgttggttcctttatggaaggtggcatttagaagccaggatttgggctgagcactgtggctcacgcttgtaatcccagcactttgggaggccgaagtgggcggatcgctggaggccaagagtctgagtccagcctggctaacatggtgaaacccttccccgtctctactacaaataaaaaattagctggga

SEQ ID NO: 92795 - DNA, 1770 bp, Homo sapiens
ttaggagcaatgttttgcaggcaggtggtggatctcataaagtacattctcaagggtggggagaattacaaagaaccttcttaagggtagaggagattacaaagtacattgatcagttaggatggggcagaaacaaattacaagggtggaatgtcatcagttaaggctgttttcacttcttttgtggatcttcagttgcttcaggccatctggatgtatacatgcaggtcactggggatatgatggcttagcttgggctcagaggcctgacaggagttcaagaccagcctggtgaacatgacgaaaccctgtctctacaaaaataagaaatgaacgcagcatggtggcatgcacctgcagtcccagcctcttgggaggtggaggcattagtcagctgtgaatgtgccctgcactagagcctgggcagcagagcagacccttcctcaaacccaaaaagcgtcatgccaaccagaccagatggtcgcctaatcaatagagaccacgcccaatcaggtaaggacagacacaaccaggcatgctctttcttgttttgttttttgtttgttgttttgagatggagtttcactcttgttgcccaggctggagtgcagtggtgtgatctcggctcaccggaaccaccacctcctgggttcaagcgattctcctgcctcagcctcccaagtagctgggattacaggcatgcaccaccaggcccggctaattttgtatttttagtagagacgggggtgtctccatattggtcaggctggtctcgaactcccaacctcaggtgatctgcctgcctcggcctcccaaagtactgggattacaggcgtgagccactgcgcccagcttgttgtttttctttagacagtgtcttcctctgtggctcaggctgaagggcactgggatgatcacagctcactgcagcttccacctcccaggctcaagccatccttcttcctcaggctcctgagtagcgggagctacaggcatgcgccatcatgcctggctaatttttgtattttttgtagatacagggttttgctatgtagcccaggctggtcttgaactcctgacctcaggtgatccctctgcctcagcttcccaaagcgctgggattacagaacatgagccactgtgcccggcttattgtacagtctttactctcggttttcaccagagaactcaagggctgtgaaaagagcaggacctcaccagctgcacggcggtggtgactggctccatcttgctgtccctcccaatcacacaacatctccccttgaaggctctgcccaggcccggactcccacctttcaagatgtctgggtcagtgcaggacctcctccttggccacatcgctctccttggactggttcaagtgattctcccacctcagcctcccaagtaggattacagtgttgactcacctgtggagtggtctgagcctgaatgcccggggctgtggccaccgagtgaacgggctgtgctaaggggaattgccaccttgggaaccctgtgtagttacggcttttctgattaagtatcaataaaagtctgaccttgtgaaaaaagcaaacgtgagtggccctgcttatgtttcaccttgcgttgctcagtgatagttctgcaaagtcgcaggaaacctggaatcatctaattatcgtgagtgttggtgagtaacacccataggcactggctcccggggaaatacagagtcaggttcctccgagccgctggccacagcatttttgttaagcagttcatcgt

SEQ ID NO: 92796 - DNA, 572 bp, Homo sapiens
cgacaacgtcacccgcagaccggccaatcccgccaggccgcggcccagtggcgccggcgcgcaccgaagacgacaccagccatccggccaatcccgccccgccgcgccccgcaggcccgcccactcctcgcttctccacttcccttctcgaagtgtccggtcgcttctcgcaggcggcgcgcttgctgggtcacagtgaggcggctccgcgcaggcgcagccgggcgggcgaggagcggggaagctgactcagggctgcggccggggtcctgcggggtaggagcgcgaggccggcctgagggaggaggcctagcgacccatccggcgcctcccgccccgggcacccgcccgcggccgcgcatcctgcgggccccaggaggcctccatctcaaaacaacgtgtttttaggtaatttcaaacttagggaaaagcttcaagaataataccgaaaatgtcagtgtccccagcacctagatcccccagttaaatccttttccatttcaccgcgctgccccccgccccctggacggttatgtggccgcgtggggttggctctgcccagggccgcggtc

SEQ ID NO: 92797 - DNA, 759 bp, Homo sapiens
cgacaacgtcacccgcagaccggccaatcccgccaggccgcggcccagtggcgccggcgcgcaccgaagacgacaccagccatccggccaatcccgccccgccgcgccccgcaggcccgcccactcctcgcttctccacttcccttctcgaagtgtccggtcgcttctcgcaggcggcgcgcttgctgggtcacagtgaggcggctccgcgcaggcgcagccgggcgggcgaggagcggggaagctgactcagggctgcggccggggtcctgcggggtaggagcgcgaggccggcctgagggaggaggcctagcgacccatccggcgcctcccgccccgggcacccgcccgcggccgcgcatcctgcgggccccaggaggcctccatctcaaaacaacgtgtttttagtgttgactcacctgtggagtggtctgagcctgaatgcccggggctgtggccaccgagtgaacgggctgtgctaaggggaattgccaccttgggaaccctgtgtagttacggcttttctgattaagtatcaataaaagtctgaccttgtgaaaaaagcaaacgtgagtggccctgcttatgtttcaccttgcgttgctcagtgatagttctgcaaagtcgcaggaaacctggaatcatctaattatcgtgagtgttggtgagtaacacccataggcactggctcccggggaaatacagagtcaggttcctccgagccgctggccacagcatttttgttaagcagttcatcgt

SEQ ID NO: 92798 - DNA, 446 bp, Homo sapiens
ctgggcaatatggtgagactttgtgagcatggtggcacacatctgtggtcccagctacctcagaggctgaggtgggaggatcacttgagcttgggaggttgaggctacagtgagccaagattgcgtcactgtgcatcagcctgagtgacagaggaagagtctgtctccaaaaaaaaaaagaaaaacgatagagattcttgggcccaagagtttgcattctaaccaagctcctaggaatactgatgctgctgccaatccatggaccacattttgtttttttgtttttttttttttgtttttttgtttttttgagatggagtttcactcttcttgctcaggctggattgcaatggcgcgatctcgggtcactgcaacctccacctcccgggttcaagtgattctcctgcctcagcctcccaagtacaagtaggtgggattataggcat

SEQ ID NO: 92799 - DNA, 325 bp, Homo sapiens
tccatgggggatccatccttggcagactgctctcattattccgcatctccctgggtaatatcatctactcttgcattggactcccacccatatgctgccttcctaattaatatctctacccctgatttctgccttcactttcagactcacatctccaactgccagctggacatctcctcttggccattcccacaggcactcagaatgactctgaccagccaaacccatcttcttcctccagatctgctcctgttctcatcctgtctcagttcatggtgccaccatcttccagacatatgagtttgaaaatgacatcatccttcaa

SEQ ID NO: 92800 - DNA, 324 bp, Homo sapiens
gcacccaagttttgggtgtttttgttcaatcctggccaatcctaaattatcagggaggcgattggcagggctgggtcgttgaagtgaggtctcttttccgtttcctgggctgctctggaccccaccttccgtgaaaacaccttgggctaagcagagtgggaacagggaccaacgccacctgcttccagtgctcagcctggtgggaatgactgcagggtgttctggtctcaggatggtccactcttgagctatctggtgtgagccatatggaaactcctctccctctggccccttctgctattaaggagggaaattttaccttaa

SEQ ID NO: 92801 - DNA, 522 bp, Homo sapiens
aaaaaactcataatgttttaagaaagtttacgaatttgtgttgggccgcattcaaagccatcctgggctgcatgcggcctgtgggctttgggttggacaagcttgcatgtgactgagtttgttcttaaactggtaaggaaactttgtcaggcagtatttatttccataagtggtgttttcctacgaatcagcacatggtgaaaaatgaggggctatgtatatttaaggtgcagaattaaattggtttaaatatcttttctattttgagctttgattttgataccttaaaggaaatatcaacagtactatttccaacctgaagcctcctcagctgttctgtcctagacttatggcgtcctctagtggccactatgggcagctatgatcctgttaccttccccagcagttcccttcctgccctgttccccactgctctggcttgggtcaagccaggcctgcctcccgccaacatattcttcagaattttacctcatgtaatagctgatgagcttaaaaaaaaaa

SEQ ID NO: 92802 - DNA, 266 bp, Homo sapiens
gcagagcaaagccactcatttactccactagtacttactgtgtaccctctagaggccagatcctggggagcagtttcggagcaggcacagaaacacgaggcaggatccttgacttcagggacctcactgcagggtacctcatcaaatctgcttacacagtccgggtatcaagcaccatctagaagtgatttcagtgtgggcctctaaaagacagagagaaaaatctataaccataacatcatttcacatcttttaaaaagcgacca

SEQ ID NO: 92803 - DNA, 443 bp, Homo sapiens
attggcagatccctggtaccgtttcaggacggagtcaaatctccaaattggtctcccagggaattagaggtaatttgggggaacagtctgcacttcttgggcctccctcggcacagatcagcctgagccagaggaaactaactgccaacattgggaatttcccttgtaagattgtaagtctgcctcttcattttttgtgttttcttgaacatgaaaatggagtctgccccttactccaagaggctagtaatggggtctcttaaggataatgatgcattgagagaagtagtgtctgaaataataaagtatgtcttaacaaatattggacaagtcaattatttaaattgttccaagctggcaataaggagcaggatgtctgaggaggagggtggtacaatagacacattggctgatggacttttttgtaggtgcatcagtcaatg

SEQ ID NO: 92804 - DNA, 162 bp, Homo sapiens
tcctagaagctgactgagaaagggctgaggttgtctgagcctatcctttcatatcagtacgaggaaagcaattaaacctcattgcccctgtgaaaagcagcaagcaagcagcgatggagattgaaaaggagcttctagaaccgggcatggtggtacatgcct

SEQ ID NO: 92805 - DNA, 386 bp, Homo sapiens
gctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttcccccaaaaaaaatta

SEQ ID NO: 92806 - DNA, 1827 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgaatctcactctttcatccaggctggagtgcagtggcacagtcttggcctactgcaacccccacctcccggtttcaagcgatcctcccacctcatcctcctgagtagctgggattacaggcatgcaccaccacacctggataatttttctgtatttttactagagacggggtttcaccatgttggccaggctggtctcaaactgctgacctcaagtgatccacccaccttggcctcctaaagtgctgggattacaggcgtgaaccactgtgtccagttgccaaacctaattatgtttaaacatgaactctttttttaattaaaattttttaaaattttatttacattaaaatggagatgggatcactatgttgcccatgctggttctgaactcctgggctcaaagatcctcccgccttggtctcccagagtgttaggattacaggcgtgagccaccacacccagccagtgaactcttcttaataaaactttaaaatttggcaaaagtttagtttgagtttttaaaaactaggaagacagacgagaaaaaagaaaacagagtcagagctaaacaatgttaacattttgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtga

SEQ ID NO: 92807 - DNA, 1241 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtga

SEQ ID NO: 92808 - DNA, 2076 bp, Homo sapiens
  misc_feature (293)..(293): n is a, c, g, or t
  misc_feature (700)..(700): n is a, c, g, or t
ttgcatctgctataagtgttctcacatgtcgttcttcctggtgagagcgggctgcatcattctggcacttaatttgggtgttcgattttgctatagagttctttgcagtacagcatagcctcttcttggccttgggaacagtgaactcttcttttgatggtgtggattgcatgcatatctggagagaggagggctcaggactgtgttcactttatttggtcagatgtattttatttgaaaaccatttgagcccaaaatacaagtgtacccttcccacttctggctcaagcacncgtgagccgctgcgcctggcccattctcatcttattcaaattactggcacatgggcaagagagacaatgacatggatagaagcttttctgcctttctctgcacacacatacagtgaaggaaccacaggcagattttttgatcagtttggtgaatacattgctcgttgtcactgttccaaccacattggtaaaaaaaatagttaccttttgtcctttggatgtcatgtctaaactttggaaaatataagtcattgcccttttagagaatgtttgtgtagtccaaagattgtgagctccatatagtatgaaaatcaagtacttttgcatgagcaatagcagtttcaaagtgaaatattataatttaatctttttcaagtagatcaaaaattcttaactgattaataaantattttatcaatatatcatccccctttcagagagaagtccccagaagagacagcacacttagcaattgccctcattattaaaggcctaggtgagtggcataaagggccatatgcgattatgtttcaaggtaaacattacctaaccttgtgtgggttaaaaacagtgaacagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcgatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactat

SEQ ID NO: 92809 - DNA, 2911 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggcagatcacctgaggtcaggagttggagaccagactggccaacatgacgaaatgctctcgctactaaaaatagaaaaattagccaggcgtggtggcacacccctgtagtcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcgatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgtaaaaagtaac

SEQ ID NO: 92810 - DNA, 2839 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggcagatcacctgaggtcaggagttggagaccagactggccaacatgacgaaatgctctcgctactaaaaatagaaaaattagccaggcgtggtggcacacccctgtagtcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcgatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgtaaaaagtaac

SEQ ID NO: 92811 - DNA, 2713 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggcagatcacctgaggtcaggagttggagaccagactggccaacatgacgaaatgctctcgctactaaaaatagaaaaattagccaggcgtggtggcacacccctgtagtcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcgatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactat

SEQ ID NO: 92812 - DNA, 2848 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggcagatcacctgaggtcaggagttggagaccagactggccaacatgacgaaatgctctcgctactaaaaatagaaaaattagccaggcgtggtggcacacccctgtagtcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgtttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcgatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgtaaaaagtaac

SEQ ID NO: 92813 - DNA, 3013 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagggtaatcggggtgaaggactgagagtggaagctgatcagctggagcatctttctggtcattcagaggcctgctggggaaacctttgacctttgagttggcagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggcagatcacctgaggtcaggagttggagaccagactggccaacatgacgaaatgctctcgctactaaaaatagaaaaattagccaggcgtggtggcacacccctgtagtcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcgatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgtaaaaagtaac

SEQ ID NO: 92814 - DNA, 2263 bp, Homo sapiens
gttacagcattatttaacagtgaaatgttgttctttatattaaattgtgtcttcctgtctctatagtgcatatacatagaccttgtgaccacagaatttttgctattcgaaacttttattgaaaagttttcttagcctaggcaacacagcgagacctagtctctacaaaaagatttagccgggcatggtgtcatctgcctgtagcttcagcttcttgggaggctgaggcaggagggtcacttgagcccgggagtttgaggcacagtgagctgtaatcataccattgcatggtgcactcctcctgggtaccagatgagaccatgtctctaaaataagaaaataaaataaagggtgtgggatttgttttttcagtaggcaggcgtttcacggaatatgggacatcagtgagcaatctaagtttctaggttttcttttttaggttttcttaaaaaaagatgttccctcaagtaactcttaatagaactaatagtactctcaattgtttttttcttacagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggcagatcacctgaggtcaggagttggagaccagactggccaacatgacgaaatgctctcgctactaaaaatagaaaaattagccaggcgtggtggcacacccctgtagtcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcgatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgtaaaaagtaac

SEQ ID NO: 92815 - DNA, 1773 bp, Homo sapiens
ggctcaggactgtgttcactttatttggtcagatgtattttatttgaaaaccatttgagcccaaaatacaagtgtacccttcccacttctggctcaagcacccgtgagccgactagacgtaatattaaaacttactgatgctgggtgcggtggctcatgcctataatcccagcactttgggaggccaaggcaggcagatcacctgaggtcaggagttggagaccagactggccaacatgacgaaatgctctcgctactaaaaatagaaaaattagccaggcgtggtggcacacccctgtagtcctagctactcgggaggctgagacaggaaaattgcatgaacctgggaggcagaggttgcagtgagcagagattacaccactgcaacgagactcgggcccagacgagatctgcctgggcgacacagtgagactctgtctcaaaataaataaataagtaaatagaacctcctgagctaccctggcttataaggattcagattactttaggaaattaggcattagcactaggaggggggaagatggctggcaaaacttctagctagcaacctatgtctagcacatgggtaactaaccatagcgagatcctgaacacatatcctctaggtgcaggtggagggaacgatgtccaatacctgaagcagaatctcacatggacggaacgtctgtatttccctctcctgcacgaatcactcatcattcttggagggcttctctgcattcctccttttcttctctcccctcccctgccttttgtcttttctaaagagtctgaactccgatttccatgctctcctgctacattaataagcaaaacctgcttgtgtgtacggttctttactggaaacatgactttttgtttctgtattggttttactgtcatccagttttctagtttaatatctagcaaaactaaatctgaatgtactcgctttttccgttaagtatgccaagcacctcggttgaaaggcttgactcaaaccagaagtcttgctggaattcgtctctgaacacttgaaaaacagaaaccctgagccgcaacaaacatgcctctgtgtgtcgggattgcctttgtctctgcttccatgtggcttttccttttgtagctatgcttagtgacataatcttccctcttctagccttctcctttcaagcctgtctgttaattaaccatgtcagtattggcaagcatttatcttcccccaccctaacatgcgatcttctaagaattttgcaaaattctaaacaaatatagagatggtatatagaattcatatctagaaaactttgattttaatgtgagcttatcaaatttgttctggcttttttggcactaaggcaaaaacatgttaaccagaaataatttattcttcatgtatgtaaaatatttgagaatgtttagccttttattagaattttatttggaaaatatttatctttctacacattttacacttatgttcctttgcttataacccaatttcttaacttttttgttacttaagcaaatatcaattatgttttattatctaataaagtgtaagattcttactatctaaaatatttaattctgtgtgactaatatacttttctgatcattcaaattgaatatgaaaagctagaataactgtattgcaactgttaattccagccaattgtataatgataacactggtgaatttctaagtaaatctaatacttgaaaatttgggtatacatagaaaataaattttaatataatgtaaaaagtaac

SEQ ID NO: 92816 - DNA, 1580 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggtggattacctgaggtcaggagttcgagaccagcctggccaacacggtgaaaccccgtctctactaaaaaattaaaacattaggcgggcgtggtggcgggcgcctgtagtcccagctactcgggagtctcgctctgttgcccaggctggagtgcagtgacgtgatctcggctcactataactccgcctcccagttcacaccttagctcccggtcgtacggccgctaatttagtagtagtaggcggccgc

SEQ ID NO: 92817 - DNA, 1088 bp, Homo sapiens
  misc_feature (293)..(293): n is a, c, g, or t
  misc_feature (700)..(700): n is a, c, g, or t
ttgcatctgctataagtgttctcacatgtcgttcttcctggtgagagcgggctgcatcattctggcacttaatttgggtgttcgattttgctatagagttctttgcagtacagcatagcctcttcttggccttgggaacagtgaactcttcttttgatggtgtggattgcatgcatatctggagagaggagggctcaggactgtgttcactttatttggtcagatgtattttatttgaaaaccatttgagcccaaaatacaagtgtacccttcccacttctggctcaagcacncgtgagccgctgcgcctggcccattctcatcttattcaaattactggcacatgggcaagagagacaatgacatggatagaagcttttctgcctttctctgcacacacatacagtgaaggaaccacaggcagattttttgatcagtttggtgaatacattgctcgttgtcactgttccaaccacattggtaaaaaaaatagttaccttttgtcctttggatgtcatgtctaaactttggaaaatataagtcattgcccttttagagaatgtttgtgtagtccaaagattgtgagctccatatagtatgaaaatcaagtacttttgcatgagcaatagcagtttcaaagtgaaatattataatttaatctttttcaagtagatcaaaaattcttaactgattaataaantattttatcaatatatcatccccctttcagagagaagtccccagaagagacagcacacttagcaattgccctcattattaaaggcctaggtgagtggcataaagggccatatgcgattatgtttcaaggtaaacattacctaaccttgtgtgggttaaaaacagtgaagtgtccttgtatcctgataaaatttttttttaaataacatggtgggttgacatttttgcatctgctataagttttctcacatgtcgttcttcctggtgagagcgggctgcatcattctggcacttaatttgggtgttcgattttgctatagagttctttgcagtacagcatagcctcttcttggccttgggaacagtgaactcttcttttgatggtgtgg

SEQ ID NO: 92818 - DNA, 404 bp, Homo sapiens
cccagaggtgactttctggtgttacgtattctaggaggtactgagaccagaatatttaaggcaccagagaaggagaagagagaggagtagatcagaatctgacccatgttacgtgtttatttcagtattcattgaacgaaaagaagctgctggaattgagaacagaaatagtggcattggtaagaaacaagactgtgatttttctttgtctttgtactcatctttgcttcgttccatgcatggttgtttgtaatgataataggaagttacatgcaggtttactgtcatgggaattttttacattgtgctaaaatacacacaacataaaaattaggatcttaaccattttttaagtgtacagttcagtacatttaaagtacattcacattttggggcaaccatcg

SEQ ID NO: 92819 - DNA, 1551 bp, Homo sapiens
gcgcgccacggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggtggattacctgaggtcaggagttcgagaccagcctggccaacacggtgaaaccccgtctctactaaaaaattaaaacattaggcgggcgtggtggcgggcgcctgtagtcccagctactcgggaggctaaggtgtgaacctgggaggcggagcttgtagtgagccgagatcacgtcactgcactccagcctgggcaacagagcgagactccgtctcaaa

SEQ ID NO: 92820 - DNA, 756 bp, Homo sapiens
tgatattttaaatttgacatattcttgatatttgtaagaaatttccactgaatgaattttacacaattcagatactaccaattaactaattctagcctaaacaaataacattatttttaaataacaaaatctttaaaaataattttctattttgaacttttagccataatgtaagaaaataaaattttctagcagaataatcaaagagtgaaacaaagttccaacatgttttttctttgcaattaaacatggcacttttacagttatttattattcatatcagtgcacttaccgacttcatattttcaaatcaaaatacagtgtttttctccagtgaaatccttattctcatgactgatagaaaacattgccaattttgatatttccagagttaatgttaaattatttgaaagaaaattatttaacaataataaaaatagacatttcaagactatttcttatcacataattcaaaaagtacttggatcaaatcctacagagtttctccactaaaattctacttgtgcagagggcattgaaacgcatgaaaatcaacagcaggttagttaggttaattaattcggttaattaagcacctactacatgctcagctctatgctaggtgtcatgaggaattaaaaggacatgtaatgcacattttctgatttcaaggagctttaaatattattgtgtagaaaaagttaacatctatgaaaatagaagtggggcaattttgtgcttaattccatggtccag

SEQ ID NO: 92821 - DNA, 544 bp, Homo sapiens
  misc_feature (441)..(441): n is a, c, g, or t
aagtagaaactgatttacatagataattatgtgaaatagtgctgcttgactaggattttcatgatctcatttcaaagattagcaaaaacaccctttacctggtatgtttacctctgatactaccttcactgatttcagcaggtagtcagttataatccatggattgaagttttgatttatttatttatttatttgagacagagtctcactctgttgcgcaagctggagtacagtggtgtgatcttggctcactttagcctctgccttccgggctgaagcgattctcctgcctcagtgatcccagcactttgggaggccgaggcaggcagatcccgaggtcagaagatcgagaccatcctggctaacacggtgaaacctcgtctctgcaaaaaattcaaaaaattggccgggcgtggtggcaggcacctgtggtcccagctnctcgggagcctgaggcaggagaatggtgtgaacctggtggagcttgcagtgagccgagatcgcgccactgcactccagcctgggcgacagagtaaaactctgt

SEQ ID NO: 92822 - DNA, 399 bp, Homo sapiens
  misc_feature (296)..(296): n is a, c, g, or t
aagtagaaactgatttacatagataattatgtgaaatagtgctgcttgactaggattttcatgatctcatttcaaagattagcaaaaacaccctttacctggtatgtttacctctgatactaccttcactgatttcagcaggtagtcagttataatccatggattgaagttttgatttatttatttatttatttgagacagagtctcactctgttgcgcaagctggagtacagtggtgtgatcttggctcactttagcctctgccttccgggctgaagcgattctcctgcctcatnctcgggagcctgaggcaggagaatggtgtgaacctggtggagcttgcagtgagccgagatcgcgccactgcactccagcctgggcgacagagtaaaactctgt

SEQ ID NO: 92823 - DNA, 427 bp, Homo sapiens
ccactgcatgtggccccaaagtctgttttttttccccaagcccttggataagtagacaaagtatgtatgtaaatggtcctgtcatctcagtgaatgtctcattttaaattttggtgaaagcttatgctgtattgtagcacattattttatctataacattgaaaataattggcctttctaaacatggaactgtttatcatgcagtagggtaaggcagtgccatgctgtggtacttaatctggggaggatctcctcccttttccccatagagcatttggaaatgtgtgtgtggatggggttgcttttagatgttccagtgactggggacactcagtcattggatggcttaaggatgctaaacgttcctgagtgcttgggatagtcttgcagaatgaatacttgtgctgtccagaatgacaagagcacc

SEQ ID NO: 92824 - DNA, 886 bp, Homo sapiens
tgctaaaataaacacgtgtactcttctgttcatcttccaatttttttcctcagccccatttgcactctttcttgacattactctctgattctgtggtctgtgactatccacctgaacccatcaccttaaccaacttagagagttcagttgcagaagattttcttgtaaatgaaactctagcttattgatcagtggtgttgctcctcatgaaaaaccttttcagagatttacaaattgaagaagcatggtaatttgtagtcttgtaaagaatgatatccagaagattctttagttatctgcatacaaagctaaatagttaatttgatgtttaaagtattactcagacttcatactgtcatcctatggacagttgcaacatcttcgctattttttctcgtaatagatattttaaattaatttcatacagttgcagaatccagcctacttctgaatttcttccatttaaaatatacataaaacaaagtcaagagataagtagcagattggggaaaaatctttgcaatattatgacagaggcctaatttccttaatatccatagagctcttcaaatggctaaaaagaataacccaatagaaaaatagcaaacaatataagcatgaaaagatgttcactctatcattaaacataaatcaaaacaagttgcagttttccagctatcagattagctgaaatgaaaatgttggaaaaacctcagtgttaaagagtaggaaaaatagcgtgttgttgaaattatgaattgttaaacttttctgaagggtgatttggcaatatttttgaaaatctgaaatgtacatacacttagatcaagaaattccacagatatgaaaagatatgtttgtaatgatagtctttgcagcattattt

SEQ ID NO: 92825 - DNA, 610 bp, Homo sapiens
gttcgagcttcccagctgctttgtttacctactcaagcctcagcaatggtgggtgcccctcccccaaccttgctgccaccttgcagttcaatctcagactgctgtgctagcaatgagccaggctccgtgggcgtgggaccctccgagccaggcacgggatataatctcctggtgtgccgttttctaagaccattggaaaagcacagtattagggtgggagtgaccccattttccaggtgccatctgtcacagcttcccttggctaggaaagggaattccctgacccccttgcacttcccaggtgaggcgatgcctcgccctgcttcggctcacgctcggtgcactgcacccactgtcctgcacccactgtccaacaagccccagtgaaatgaacccggtacctcagttggaaatgcagaaatcacccgccttctgcgtcactcatgctgggagctgtagactggagctgttcctattcggccatcttggactaaatcgatgtcattttcattttatacacatggaaacaggctcagagaggttaggtgtcttgtccaagttcacacagctattaagtgtcagagttgggctttgaacccagaggacatcg

SEQ ID NO: 92826 - DNA, 320 bp, Homo sapiens
gcataagccaccacacccagctcagattactgtttactcaaattaatggggatgattgaggatgaaacagtgcagggattccccattgttttgttttcttctttgcatttctagtgtctgtttttttttttgttggtggtggtggtgtttttgtttgtttgtttttttttttaaaaaaagatctgcagaggctattgtgtcctttgcataacccaagtccagtagcatccttgacttcaaagtctgttggcattgatggcatctgactcagtcataactatctttaatacatcattataaaatctacaatattgctcaag

SEQ ID NO: 92827 - DNA, 366 bp, Homo sapiens
cttaatatgagctacctggaagaggcaaattcatagagacaaagagtagaagggggtggcctgggactgaaaggagagggaaatggagagttactgcttactgggtacagagcttctgcttgggtcatgaaaacgttctggaaacagtcatgaatctaattaatgccactgcactttacacttaaagtggttaaaattgtaaattttatgtttattttcactacaataaaaaacaatgaattatgtaagcatttgatttattgctgaatttgccaacaatcttggctttatttttgatcttattcctggcctgtttattttccaatttcctaaacgggctgtcccacacttgttccccttatgtct

SEQ ID NO: 92828 - DNA, 256 bp, Homo sapiens
atggaagttataatgaatgacttggagtcacatgtgtgaatccatctaaaaatcataatgttgagtgagtaaagcaagttgcagaatggcttcagagtataccttttccataaagtttgaaaacatgtaaaacaatactacatatttgttatggaatatatttttgttcatcaattattcatgccgcctcacactacatcttttggaagagtatagtttcccagtctattgatgccttggccatgagattcacttt

SEQ ID NO: 92829 - DNA, 406 bp, Homo sapiens
cgcccaggttggagtttagtggcaccatattggtttactgcaacctctgcctcccgggttcaagcaattctcctgcctcagtctaccagggagttaggactacgggcctgtgccatcacgcctggctaatttttgtatttttcatagagataaggtttcaccatgttggccaggctggtctttaactcctgaactcaagtgatccacctgcctcggccttccaaagtgctgggattacaggagtgagccaccgtgcccggccatgtctctctttttaacactaatgttaccctgacctttgaacgtagaatgcccttctgttgcaggaaaacctcttttcaaaccatgtttgtcctttgctggcatgccacagcaacagtcaccaacacagaagacttctgtgacc

SEQ ID NO: 92830 - DNA, 413 bp, Homo sapiens
tccaaagctagatattgttattaaccagtcagactattcctttaagatcattcatttccatgtccccccattgctctccacagccaagcctctgccagtgtgaccacagtccatcagatatggcaccagtggcagatggaaatgacttctattccaacaacgcttattgaattacttgaacaagtggatacataagactaaagtgccatctaatttgtctcacctgtagaagccaactcttactttccacttagccaagacatcatgataaatgaacagtttattttaacattgctatttatataacaatcgtatttctaagttattggtctgagcacatcatggaagataccctagctcactaggaacaagactaagaacagagatatgaaagcaaggagagagagagagaa

SEQ ID NO: 92831 - DNA, 333 bp, Homo sapiens
tggaggccagaaggccagttaggaagctgtgccaatgtccatgcatgggaggtgatgtgttctgagtttagagaagctctggggactgagagagcaagtgtgtgcatcttcacaacaggggacctgataaataaatctatgccacatccctgaaagattctgcaaccacagccactgtgcagatctgaataaactgccaacgtgcattttgagcagaaacagcatattgcacaactgcacagatattttatgagcccaactatgtaaaattaaatactcatttctgtatcagtttatctatatataaagagacatctgggaagataccgagtt

SEQ ID NO: 92832 - DNA, 292 bp, Homo sapiens
cctcttctgctgccttctctctctctgacccggtgtcttttctttaatacaacagacaacagaaacaggtgtcaaaaagagataggcgccgggcacagtggctcgcgactgcaatccagcactttgggaggccgaggcaggcgaatcatgaggtcaggagatcaagaccatcctggccatggtgaaacccgtctctactaaaaatacaaaaattagctaggcctggtggtgtctgcctgtaatcccagctactcaggaggctgaggcagaagaattgcttgaacccaggagg

SEQ ID NO: 92833 - DNA, 265 bp, Homo sapiens
  misc_feature (228)..(228): n is a, c, g, or t
  misc_feature (244)..(244): n is a, c, g, or t
attttcttcaattcactcatcaaaacaagctatgaaataagcagaaccccaatccagaagaaggaggactgaaccaatttcagtgatttgcttgagatctccagctggcttcttttagaggccggcttgaaatccagaagagctgaccctctctacctacccgggctccttgcactctagccctgacccactccccacccacacttggcagaagcttcacaccttctntagaggaagtctttcnttcactcctacacacatattt

SEQ ID NO: 92834 - DNA, 341 bp, Homo sapiens
tgtcttccttcccagcttcctccgtgtctggggtgggggatgggggggtctcaggcagggatactctagccccttgactgctgtttagaccctgctgtagctgctgctgctccctgcccagccccagccatgaaactgcccaaggggaccaggagctctgtgtactttgcacagcacccagaaaaggagccattgccctcaaggcaggaggtcaagcagacccctgtcatcatggccaagatcaaaggtccggggcccgccaagtacctccggccatcctgcacgggctacatagatcatgacatctccatgttcaaggcaccagcttataccctgcatag

SEQ ID NO: 92835 - DNA, 463 bp, Homo sapiens
tatagattgttagattttctaaatttttgttgcatatatattttataagctggatgtggtggcatgcgcctgtagtcccagctcctctggaggttgaagcaggagggtggtttgagcttaggtgttcgaggctgcagcatgcaatgatcacacttgtgaatgaatagccactgcacttcaacccaggctatacagcaagaccccatctccattgaaaaatatatatatagctgagcacagtggctcacgcctgtgctcccagcactttgggaggccaaggcgggcagatcacaaggtcaggagatggagaccatcctggccaatatggtgaaaccccgtctctactaaaatacaaaaaaaataattagccaggcgtggtggtgcacacctgtagtcccggctactcgggaggctgaggcagggaaattgcttgaacctggaaggcagaggttacagtgagccg

SEQ ID NO: 92836 - DNA, 531 bp, Homo sapiens
agggagcctgcacagagtaggtgcaaatggcaggagccaccacctgccagcatcccccaggcctccccagtggagtgggggcagaggaagtggtgacctactgccccctctgaggagaaccacccagctgtcaacccgaggcgggaccgccccgagcgatcgcaggctctccatttctccaaagcctccgttcctcatcacagccaattagttacaaatagcttcctctcctcgtgtatcacttacacaacagaaaggggtgattgttcctgaggaagaaggtctccctgggcccctctcgccagagcagctgagagctgcaatggggatgggaaaggggcttaggagaagaggggcacagtcccgggaactaaggatgtggtgggtcccaggcaggtgggaagggactggctgagtgtccacccctggtgggcaacagacaggtaggggtccaaggcttagaaagggccctgtgttgtaagagcagaaaatgaagatagctcagaggcctcgctcctgaacagcagctca

SEQ ID NO: 92837 - DNA, 355 bp, Homo sapiens
ttcttacggatatggtgacctattctccgacacatggaatgcatttactgattatgacgttatacatttgaaaacttatgattccaaaagggtactggaaattttcctgaaatgtctgtgaatatttcttgagtgcagatgactcactcataaaataaacatttattatgagttcctattagccattaccactgatttctgaatttctgaatttcttttataattagaatcctcagtgttgttaatcatgcagcctttgaaaagttttttctataatctttccaaaaatatgaattctgttctctttgaatgaaatagtgtgctattcaagcaatgcaaaatggagattaattaa

SEQ ID NO: 92838 - DNA, 212 bp, Homo sapiens
ggggctggatgccaccccctcaaaggagcacagacctgctggccccccttccctccctctgcaggccaagctcatgagctgtggggagtgggagcagggggtccctcccacatcctcaggaagaagccaccatgtcattgggagcctgtgttacacatcagtgtgtgagggaagaatctggaaacaactgactaagaggatggcatgatctc

SEQ ID NO: 92839 - DNA, 414 bp, Homo sapiens
gaactttgcaatgagtgcttcatgatccagccaaatatggaataaaggtgtgtttgacaaatcttaactcacattgcgtgacacaccaatgttatgtttgtggcttagatgagagtttgctgccttggtattagcggagccagcaaccttgtgagaaaaacttggaagtgatgcagctgcctcctgagcctacatttgggatcattcccctcgccaaagcttcgcccaaacttggtgctcagtgtttgtccccagactggatcctggctcacattagacaagtccaacattggtggcaggcaaagtacagcaagtgtctatcaggcaggcaggagaacacataatgaaaatttaaaagctgtataaatcttccgggattagaaacacatggagcaggaatcaggcaagggtcgt

SEQ ID NO: 92840 - DNA, 491 bp, Homo sapiens
agtacaaatgtcttgtgggactctcactttttttgtaatgtgtaacattattacagaaaatatgggctaagaagacttcagaaacacaccactgacatggtccagacatcgattgaatgatggggcaataccaacaacaaatgcagattctaagagcgtgctttctttgatgtctgtgtttaattccattgattttctgatgtctccgcaacaccgtctgtgggtttttcaaacaaatggtaaagggtgtgatgttttctaaagaagatagagttaaggatggtggttgtgaatgtcttgatttgtgaatgtcttgcacatgtgaaacattaacagagacataaagctatcagttgtaaaccttgtagctaaattgcaaaggcacagaggaatgtttgacttatgtaactcttttgtcttcttaaaaaatttaatgatacctttcacagaggttattttccttgacatgcagagtgaccatagaacttctc

SEQ ID NO: 92841 - DNA, 166 bp, Homo sapiens
tgtccaacaagccctactgagatgaacccggtacctcagttggaaatgcagaaatcatccctcttctgcgtcactcatgctgggagctgtagactggagctgttcctatttggccatcttcaacacttggtcaatcttgttttactacacctcagatctatttacc

SEQ ID NO: 92842 - DNA, 293 bp, Homo sapiens
  misc_feature (153)..(153): n is a, c, g, or t
atccccggctctgggtatcccggctctgggtagctaggattaaggtgccaccacacgcaggctaatttttgtatttttagtaaagacaggtttcaacctgtttgggctggctggtctcgaactcatgaattcaggtgatacgtcaaactcagncttccaaagtagtgggattaccggcatgagccagcggaaccaggcagagcataaacgtttggaaaatttgcagcctgaagatgtgatagaaaagaattttctggggaggaattcaagctggctgcagacatttgcataag

SEQ ID NO: 92843 - DNA, 503 bp, Homo sapiens
caataatccaatctgtgaagctgaatttacgaggtaagggcataactcaaaacctgcttgtttaaaaatgcaacaatttagggcagtttggagtagtgatattatacaccactttgcattttgaatggcagtgaaactattctgtatgaaactataatagtaaatacatgacattacacatttgttaaaacccacagaaccatacaacacagaaagtaaatcctaatgtaacctgtggactttaactaatgataaagtaccaatattggtttctcaactgtaaattgtatcactaatgaaagttggtaatagagaaaactgtggtatgggggcacacataggaactctctatactttctgtgcaattttctctgtaaatgtgaacacattcttaaaaaataaagcctatttaagaaaataaacacatcatttccctttccagggactggcttagaaatggtctaatgaaattgtcaaagagctctcctgtggagcttcggaga

SEQ ID NO: 92844 - DNA, 539 bp, Homo sapiens
ggtctcaaagcatcactgcaagcttcgccaagccccttctctggaaaggcctgagagacccccctcctgccaactgccagagtgtagattatcagtcccattgacagacaaagacgtagcctcagaaagattaaactacttgccccaggtcccacagctaagaaaggcaggatttaggctggacacggtgactcatgcctgtaatcccagcactttgggaggccaaagtgggcagataacctgaggtcaggagtttgagaccagcctgggcaacatggcgaaaccctgcctctactaaaaatacaaaaattagccaggtgtggtggcacatgcctgtagtcccagctactcgggaggccgaggcaggagaattgcttgaacctggggggtggaggttgcactgagccgagatcctgtcactgcactccagcctgggtgacagagcaagactcctctcaaagaaaaggcaggattcaaactctacaggcctgtctgacttcacattcagggctcttggctttttaccatgctggcccttc

SEQ ID NO: 92845 - DNA, 517 bp, Homo sapiens
gtcacacaattaatgagcagcagaaccaggattgaaatcctttgatctttctacccattcatgcagtttaccatttaatctgaatgtcattattcagggctttttatctgcttattcttttgttcttacgttagactcatatggaaataattctgcaaggcaagggaagcggaaagaaggaagataccctgccaattgtcagaataaaagtttgtttagcagcagatagagaggaggggcaggaccagagactggacatgttcacacaggcatgcatacagaaagtgtccccaaaaccacaggggcaagaggcagcagatggtttgtatcaaattaaggaaggaaatcacatgtatagaatatgacaatgtgccagacactaagacaggtggagatgctttatttaggttatctcagttaagcctcaccacagggcttgagatatgactattaagatctgacggcaggtggtagcaaggtctcagaatccttcagtgttcatgttaggattcaggtt

SEQ ID NO: 92846 - DNA, 558 bp, Homo sapiens
gagatctcatctatacaaaaaatagaaaaattagccaggcatggtggcatgcacctgtggtcttagctatttaggaggctgagatgggaggctcagttgagcccaggcagtcaagggtgcaatgagctatgatcacaccgctgttccccagcctgggcatcagagcaagaccctgtctcaaaaaaaaggaagaaagaaattcacacaaaagtggatccacaccattcaaacccatgatgtccaagggtccactgtacatgctcatgctcattagcaatattttttatcatccaggttggagaagagaaagctgagcccccaagatgtaatttgttcaaagggacactgctaataaattagccatggtttcaatcctacagtataagaagtgtaattcaacttggtccaacagatgtgaatgcctaccacagaagtcattgagtgtctttctaggatagaaagataaatcatatataagcctacgctctctggtagggaaaattattaaaaatgaaaattaaaaaagcaatgattctgaaaaaatatattcgttcatta

SEQ ID NO: 92847 - DNA, 550 bp, Homo sapiens
aaaaaaagaaaaagaaaaagaaaattagccgggtgtggtggtatatgcctttaatcccagctactcaggggaggctgaggcaccagagaatcccttaaacccaggaggcagaggttgcagtgacctgagatggcaccactgcacttccagcctaggtaacagcatgacactccgtctcacaaaaataagtaaataaatttatcttagggcctcaccatgttatggagttgagtctaattgtttagaagagaagaggctaagaggctagacaaggacatagaaaaacattgttcagcctgggagaggctagatcccatgcagatgtggcccagtttttatcaaagtagcctgaggaccaccctaccagggccattaggagtgctggctaaaatgcatattcctagcatacttcccaaacatactgaattataatctcaagagggaaagcttaggaaaaatgccaagtttgtagactgacatggtgactcacacctgtaatcccagcactttttgaagctgaggcggtggactgcttgagcctaggagttca

SEQ ID NO: 92848 - DNA, 299 bp, Homo sapiens
cccagtggccctggtaggcccacaacttcccgaagccaagttccccaggcccaggtcaggcctcacggtggcctctccaggctcagctcctgccctccgatggcatctgcaggccccaaacggcctccggtcggtgggctcctctaggcccagcttgggcctcctggcggcctctgcaggcccaaatcgtcccgaagtcggcctctccaggcccagcttgggcctcccggcggcctctgcaggcccaagtcatcctcaaatcggcctggaattgggcctggaagagcagcaagtcggcc

SEQ ID NO: 92849 - DNA, 213 bp, Homo sapiens
ctgcctcacctttcaaaatgctggaattatagacgtgaggtactgcggccggcctttgctctgctgctcttcctgtccagcctcagctgtctggctgctacctgtgcaggttctgcaggggctgtgtgttccctcagcccatttcccagcaccacctgcctgcttgcttcctgctggtcatgactgggctcctgctatacattagccttcccc

SEQ ID NO: 92850 - DNA, 159 bp, Homo sapiens
ctttgtggctgagtgtctgcctgctgtgtctgtgacccagaggaacgaggctgctttgagccctgtcattgccagcgtgtgcttcttcagcaggcaaaggttatgcacaaagttttaggattttttttttaacttttgggattttatttgcttaggaag

SEQ ID NO: 92851 - DNA, 161 bp, Homo sapiens
aaattaagaatataaagcagtacagtaagtatatggggacatcaggagttgagagaatagagagatccttgtggctccatgcaggacatagatcggtcagttatattgaagggagattttggaagggatggcaaacatttcaggaaggaaaagaaaaagaa

SEQ ID NO: 92852 - DNA, 911 bp, Homo sapiens
tgaagcagcaacacttaaggtttatgtgattatttctagttctagatccctgaggaacaagtagttcacaggtcaagaagtatcagtggtccataacatgtggaatgatgctttatatcaagagatgagcaactgagagcacactgagacatcaacgtttacctttcatactggcaaaatcccaggagtttgaaatatgctgttggaagagctgtggataattgggtgcttttattcttggtgagagtgcaaactgttataacccttatggaaaggcaacttcgcaatacttaccaaaattacagaggcatttttctttcccaggtatgtgtggtaatttattattcagatacactagcacatatatcagatgacagaggtgtcaacgtgctgagagctaacacgccagagttggaagggctctgttgaaagatagctggcttgctgctccctggacagctccactctgaaatgcagctctcctgaacagtcagcaccagagctcagaaatacctcctcccacccccatagttttcatgccaccctcacgttccccaaattccttagtgtagagaaccaaggaagcaacatactttgggaagtctggctctgacagcaagtggttcgtccactgtggctgggcattgcatttcttggtaggatggggagcctggggaagtgcgtgcattccgctcaccttccgcctccaaatattcccagttaaatttatagttttttagtctgttgaatgttgttacctgtattggtctttatactctactccacaaataggggactgggtaaataaaatatggttacaagtcaaaaaagcaacccaattgagtcaaaaaaaaaaaagcaaggtatgaggtatatgctatgacagttttgaaataagcagggaagttggg

SEQ ID NO: 92853 - DNA, 272 bp, Homo sapiens
tgtgtactcggatttgagggttcaaattcataacattgtattgatccctcttaaatgcaccagtaaaaattagtagtatgtggtgaaaaaacaaaatggactttggagataggaagacttgtgttcaaaacctggccttaggcaaataagttagctccctgaatttttatttcatcacctgtaaaatagaccacattcctgcctgggttgtagttaccattaagaccatgtatattctgaggcaacacattgtctgtcttatagaagatgct

SEQ ID NO: 92854 - DNA, 690 bp, Homo sapiens
ttggcctcctaaagcactggggttacaggcatgaaccactgtgcccagcctgcatgatgtaatctccaaattgagggtaagtaaaaagtagcacctataactagaggtaaatttttaatttaaaacaactacactacgcaatagtcatctcctcagcccttgcccacgagatcttatgaacctcctcaatagaaaaaaaggaatagtctgtgataggatcaaaggaacaggaaccctttacatggagagtaattttaaatagctacaatttttgagcttgtccgttgataccgagctcagcaaaagaaaaagcagtgattacaggcctgaccactactcaatgattagaatattcactcttctctattacttagaaggaagcccccctctcccactatgtcaggtatacacacaagttcacagctctcagtgtttctgtgtaatttgttcctgtttcagacagctttccagaaaagctcctcttaaatcctgggtggccaatgcagaggttttaaaaagaggaaaagtagagcaaaacaacaaaaagatcatgaaatagaagcttggggagaagggagcaaagagaacatgaatctaacagatgcagcagttgcaaaaaagctgctatcctttagaaactcctgttaatttggtgacctaaagggagctatttctaaggctggatgttga

SEQ ID NO: 92855 - DNA, 990 bp, Homo sapiens
ttattttttttgttcttaatgtagcatttatttggagttgcttaatgtttttcaattacatgacacactgtttgtttacacaattttaaactttgaggtaatttgtgccaaaggatctaaagtaattctcaacagaggtaggaatggagcaattttgcccaccaatggacatttggtaatgtctccattcttctcatagcctgtgggaattggagggaaagagtgctttttgtctgtagtggcagagcccaagttagctactaaacaagctaaagcgcatgggatggtctgctaaaccaaactgtctttcagaaatagtcaacagtggcaaggttgagaaaccctgttcttagaggttcaaattatacctgacacataggaggtaaaagcatggagtctggtaactgaaaacactctacacactctaaattcaaaactacatgggtgtaaatatccaccatttgactaacagaatgaattcaagtaattcaactcgtttaacaatttcaaaatttttgagataatccacgtaattcaaatacttagttcagttcctgacatttaaaatgtgcttctactaccctgtaaacatttaattgtatacttacgtatgaaaatccaaaattaatgtcactgaattcctcaagtttctatgatgtgatgacttacacacacctatgtgaaaacttgctatattccccatcttaaaattatgaatatacttcctggcctttgaaaacctgcaccatggctaagcgcaatggctcacgcctgtaatcccagcaccctgggaggctgaggagaatggatcgcttgagctcaagagtttgagaccagcctgggcaacatggcaaaaccctgtctctaaaaaaaattacaaaaattaactgggcatggtggcacatacctgtagtcccggctacttaggggctgaggcaggaggatcacttaagcccgggaggtagaggctgcagtgatccatgtttgtac

SEQ ID NO: 92856 - DNA, 468 bp, Homo sapiens
tactaatgttataactggacacgttttaagtaggttttttcatttatttacgaattcatacagtaaatattgtagtaggttctccagaaactattatgaacaaaatgtgaaaatgtaaatacatttgaggaagaatttttttttttttagacagaatctgtcacccaggttagaggacagtggcacaatctcagcttactgcaactttcgcctcccgggttccaagattctcttgcctcagcctcccgagtagctgggattacaggcgcccaccaccacacccagcaaatttttgtatttttagtagacatggtgtttcaccatgttgaccaggctagtctcgaattcctgacctcaggtgatccacctgcttcacaatttgagaaaccaaggcaggaggattgcttgagctcaggagttcaagtccagcctggacaatgtggggagacctcatctctacaaaacata

SEQ ID NO: 92857 - DNA, 397 bp, Homo sapiens
cagagattcataaaatgacctcatctttattcaaaacagggctaattcttttgctgtttttggagtagagttctaaatatcttattttcattaactgatttaaaaatatattttatataagacatgtgcaggcatgaaaatcataggaattggtaaaagtcttaaggaaagtaaaaaaatttgggggaatgattggtttgtacttatatacaaatacaaaaatctttgggttgaatttttagttaaaactttcaataatttactttctctgttgtttttcatcataatagttgttttgtaatcagcattagaagacaaataaatattgatactattcaagtaaaaggccagctaattttagcttcgcaagtcgtgttacctctcttttcatgtagaa

SEQ ID NO: 92858 - DNA, 807 bp, Homo sapiens
aagacagagcatgagaagagttgtgcaaaatctagatgactgcaaaacccaaaatatttactttgtgagtcttacagaagaattttgccaatctttggggcaaaacctagactcaccgcttttcatctgcagaggctaaatgcagacccattgtttatttttgttgtgaccttggtttttgcacttacaaagtcagtttataacattgcccagatagagaataaagttaaaaagtgaaagctacataaaagtccttaacactctgcctggcacatagtaagccctcactgaatggcatccttgtattataaacgttattttaagttgacgttgtttccaggacaggacacggagatcttcggggaaggcagagctggctgatgaaccctacccagtgtcctgattaatgcattacagggaatcttgaaggaagtcaagggaaatgaacatttggtgagtggcactctattgcaagtgcattttatttcatttctttgattctcataaggacttggtgccatttaacaagggagaatggatgtcaaggctcaaagaggtcacacaaagatacaaaaagcctaggaatgcaagcacaggtctgtctgcttcaaagcttaaatttatatttttctctaccttaaaataagtaatgtggttgaaggagctggtgatttttacttagaaaagaaagactcagtggtgacccatcagcctgcctccaaatacttaagtgttcctgtgtaccaaagaggtctgaaatacagtagcttcagaggataaaacaaagaccctcaatccatccctttt

SEQ ID NO: 92859 - DNA, 690 bp, Homo sapiens
ctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctccc

SEQ ID NO: 92860 - DNA, 1401 bp, Homo sapiens
ctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggatttttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccctgccgcagccaatgcaggggaagggggacactcttcctgtctcttctccccagctaaagagactttggacttagggggcccatgagcctggagaggccttaaccctgtgaggaagtatagggggagccctctcccacccccatccccttctgagagtggtcaatgtttacaagcccctgagcccccctgcccagggactcagaccctgttgctgtccttccccggccccggtcttcctgggccctcgctgctcccctgcccttcctggggttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctcccaaaaaaaaaaaaaaaaaaaaaaaaaaaaaaaaaaaaaaaaaaaaaaaaaaaaaaacaaaaaaaaacatcaaaacacaactaacacccacacccttcaaaaaacaacaaaaaaaccagtaaagaaaaacacaacaatcacacaaatcatacacacatcatatactacctct

SEQ ID NO: 92861 - DNA, 1231 bp, Homo sapiens
ctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggatttttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccctgccgcagccaatgcaggggaagggggacactcttcctgtctcttctccccagctaaagagactttggacttagggggcccatgagcctggagaggccttaaccctgtgaggaagtatagggggagccctctcccacccccatccccttctgagagtggtcaatgtttacaagcccctgagcccccctgcccagggactcagaccctgttgctgtccttccccggccccggtcttcctgggccctcgctgctcccctgcccttcctggggttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctccc

SEQ ID NO: 92862 - DNA, 1309 bp, Homo sapiens
  misc_feature (1232)..(1232): n is a, c, g, or t
  misc_feature (1257)..(1257): n is a, c, g, or t
  misc_feature (1259)..(1259): n is a, c, g, or t
ctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggatttttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccctgccgcagccaatgcaggggaagggggacactcttcctgtctcttctccccagctaaagagactttggacttagggggcccatgagcctggagaggccttaaccctgtgaggaagtatagggggagccctctcccacccccatccccttctgagagtggtcaatgtttacaagcccctgagcccccctgcccagggactcagaccctgttgctgtccttccccggccccggtcttcctgggccctcgctgctcccctgcccttcctggggttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctcccnaaaaaaaaatacaaaattaaaccantnttttaatgattgaaaaatgacttcatttcccgtgaccattcataaaatat

SEQ ID NO: 92863 - DNA, 1194 bp, Homo sapiens
ctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggatttttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccctgccgcagccaatgcaggggaagggggacactcttcctgtctcttctccccagctaaagagactttggacttagggggcccatgagcctggagaggccttaaccctgtgaggaagtatagggggagccctctcccacccccatccccttctgagagtggtcaatgtttacaagcccctgagcccccctgcccagggactcagaccctgttgtgctcccctgcccttcctggggttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctccc

SEQ ID NO: 92864 - DNA, 841 bp, Homo sapiens
ctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggatttttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccccgaacgctgtaactaaggatcctgcaag

SEQ ID NO: 92865 - DNA, 942 bp, Homo sapiens
ggaactccgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccatcggcgctgaagaaattgttgatggcaatgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagatttagtatacactgccagacccgatgaaagagccataatgacttatgtttcctgttactatcatgctttt

SEQ ID NO: 92866 - DNA, 360 bp, Homo sapiens
ttcttccctctgttctccctggtttctctccttcgtctgtatgtgtgtggtgtgtgtgtgtgcgcgcgtcctgtgttattttctcccccttcagacatcgtgaacacccctaaacccgatgaaagagccatcatgacgtacgtctcttgcttctaccacgcttttgcgggcgcggagcaggtactcaacacttgtccgtccgggctgttgtgttactctctgttggttttagttgtgtgtgcatacttgagtgtgtgtttgtgcgcttcacatcttaccttggaatctttctgagtgttttctaataacctcatatggcaagttctaaactgtgaaaacttttttttaacagctttaact

SEQ ID NO: 92867 - DNA, 4182 bp, Homo sapiens
ggaactccgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccatcggcgctgaagaaattgttgatggcaatgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtgaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattc

SEQ ID NO: 92868 - DNA, 790 bp, Homo sapiens
caggagtagatatgaggacatgaagtacagtaggaactttttctttttgggctttttttggttgtttacgcttttttgtttaacatgaatgtatgttatgtttgcaataacagaaataaagatagaaacaaaagatatgtatttcctaacatatgcttttgcttaaacacttaatgatgtcttaccactccctgctccatgtcccacttcgttgcctacattgtaattgcgtgtctaaaggcaaacagccctgtgtaaactgcttagattctgttctctcatcttcctttactttactgtgtgtcccacttttcttgagctccatcatctagtattcacctgaaataggatcgacaaccatgtagggaaactgcttctatataatgagaggctttcagtatttaattgatttaattttattttaaaatgagcagggccttgatgttatgcacatctttttataaaaaggcacatttctcagaggctgctccgaatggtttagctgctttcatgagttacaatcctacagtgggagaatcagggaaaaaaatcacattactgaaaaaggcatgtgtctggcacgttcccaaggcatgagtatttatggcatggtgaactgtgaatttgatgttgatgcttgcacaacaaaagcatgtggttaaaatctatttttgtcaccagcaaaaaaaaaagaactatatttaaaagtgtaaaatgtttgttttatagaaagtctttaccccaaatgaaaaataaataaatcaaggtcagtactattaattctctatga

SEQ ID NO: 92869 - DNA, 564 bp, Homo sapiens
ccaggcccggttaaatttttctgctttttaacagagatggggtttcaccatgttgcccaggctggtctcgaactcttgagctcagacaatctgcccacatcggcctcccaaagtgctgagattacaggcgtgagtcactgcacccggccgcaggggtcttttaaggcattgataatgtccaatttcttgactttactaggaggttcataggttgctttttattcattctttaaagcatacataaaaattttaggtaatcatttggagccaggagtttgagaccagcctgggcaacaaagcaagaccccatctctacaaaaaaaaactttaaaaaattagtcgggcatggtgacacatgcttgtagtcctagctacttgggaggctgaggtgggaggatagtgtattagtccgttcttgcattactataaataaatgcctgagattgggtaatttacacgtaaaagaggtttaatttgctcacgcttccacgcgctgtacagtctgctgcttctggggaggcctcaggaacttacagtcttagacaacggaacaccgggatcctc

SEQ ID NO: 92870 - DNA, 425 bp, Homo sapiens
tattataatctacctctgtatcttcccctccttccccaatttagtcagattgaactgttgcttacaaccaaacaaccctcactgtttcagaagccaacacattcctctctctatagcttgaatctcttctaataccacccctaccagaaatcccccacatcctgtctcctgcctgcttgaattcctcatatgacaaagaggtcatttccttctaaagcaatcctagttcattgctgggaggctctgactactaagaagtttatctaacattacatggaactctctcttctctgatacctccacccaatggtcctcatcccagtttttatcccgagcttcctaacttaagaaaaaaaaaagaccactaacttgaaatggggaagtccctgttccctttcagcatccagggctggcaggctcagaac

SEQ ID NO: 92871 - DNA, 616 bp, Homo sapiens
gaaaataaggaacataatagcatattgtgctattatgatgatgaagaacctctctagaagaaaacataaccaaagaaacaaagaaaattcctgcaaatgtttaatgctatagaagaaattaacaaaaacatatattcaatgaattcagaaaagttagcaggtcaaagaaaacaaatcaaagaccaaaataatcccattttagattgtcgagtaaactagaacagaaagaatacaactggaaattgaattcctacgtaggggacatgcttgagactaaacaactcagggacttgttagatattatcagccttaacaatgtaaaaataagctataattaaaataagaaagggggtaggaggtaggaagaagcaggtgattgctaattttttcatcatttataacatgggctcaaaagtctaaaattgaaactaggtattaacagaaagcaatgactccatcttcttaaaatttttcataaccttgatgagctcttctaaaagatatccatttcaatgaagacatatttttccagaactcagaacttcctttagatgtacttgtttcctcttagaaatttaagccatgtacgttaatactctttgttaaaattgggatg

SEQ ID NO: 92872 - DNA, 146 bp, Homo sapiens
gttggagatcatagtctttaaagtatttgattatttcagaacattggataattcattatgggagtaaaaaaagtaaaccacacttcagtacagaagaaccagaataaatcaatgcttactaatacacagaaagtgtgcatctcctt

SEQ ID NO: 92873 - DNA, 302 bp, Homo sapiens
caatagattgcaaaccatatagtgattaaaataattattaggtaacttgaaaaatgcttaatggaaaaagttttaaaattagattccaggataccatgctctgaataagccaaattttggggtaaaaaaaataaaaaaccatgaaaccagacatagaagcagaacctaaagcatatttatcaaaatatctttgtttaaaaaaaatgtcttcagtggtcgtcttggctggtgggattttatgtcattttaattatctttataaaactttattctctcgaattttaaaattaacatctatttct

SEQ ID NO: 92874 - DNA, 566 bp, Homo sapiens
gaggatctgtgggcacagtcatatggtgagggcctcttggagttcattcaaactttaagggagccccacagcaccggcatgatgggtaagtccaggcctaaggttaggaagcaaatcctggagcatgaggaaattgtaggctacagtgagctaccagtggtgtgcaaactggagacccccaagacagtgagagaggccacagcatctgagggaatggagctctttcttggcctgaggttcagaagaacctgcaccaaagaaaggcatccctatcaatgtcactgttcctgaaatgatgggagaaccacatccctgcttcagggaagcagtccctgtcgtctggggcgctgagccctttggcctgagatgaaggatgatggtgtgatgtatcatggcagtgtgactgagactggattgggggatggggacaggggaacataggcaaaaatacacatgtgccactggatcctgagctgccattgtaccttggaggactggcgtttctctgggaagttgggaggtgggaagaggaagggtctcattttcctgccccttgaaaccatgct

SEQ ID NO: 92875 - DNA, 396 bp, Homo sapiens
acaaattgtcatcgtcagaaatgagggatgtttaaggggttagtacccatttttaatattagagaaataataatcctcaaagcagctttgactccatattgctgttgctcaagtagagtaactagaagctgagtaaagctagaagttgtgtgttgaaagtgttgctagaaaaatctgcttaagcagcatgagtgtctagcttcccaaggtaactatggaaaaggatgcaatagcaataggaatgtgtaagttctgggctgtttaatatagttttctcaggtcaggcgtagtggctcatgtctgtaattctagcactttgggaagctgagacaggaggattgcttgagcccaggagttcgagaccagactaggcaacatcgtgagaccctgtctaca

SEQ ID NO: 92876 - DNA, 890 bp, Homo sapiens
aggtacatttctgctacctgatgggccatttaaacatttatagagaaatttcattcaactgtcatttttaatgcgtattttctggttatatgaaagctttctcatacaaaaatctgatggctgtaatagtagctaaaacattattagaaagtgtgtttccctcatgggacattcctagaaaaatctctagcaataaaaggcacttgattcactggacaagttgtaaaacaaataaggtatttcagatacaatagcattaggcaaaggtaactgattcaactagattgtcttattcaaaagtattacagtggatacagtggataatcagatccacttccaggggaaaacgtaagttggcctttctaaaatagtcggtagagggcccatatccctaataacaaaacctcatttactttctggtctgaaactctgatatgactaaatgctacaaggctttaatacatcatgccaaagtatactttcgctagatttaaaaaaaaaaaaaggcttttcatgatcagtgactgtggacaatcaaacccttcatggtctaaaacccagagactggatattctgaaaatgatatcagaaaaagactgccctttgctgagcacagtggctcacacctgcaatcccagtattttgggaagccaaggcgggtggatcacctgaggtcaggagttcgagaccagcctggccaacatggtgaaaccctgtctctactaaaaatacaaaaattagccactgggtgtggtgatgggtgcctgtaatcccagctaattgggaggctgaggcaggagaatcgcctgaacccaggagacggaggttgcggtgagctgagatcctgccattgcactccagcctgggtgacagagcaaaactccatctca

SEQ ID NO: 92877 - DNA, 530 bp, Homo sapiens
gcctatgcattccaggctccatcccatgtgactctgggcttagccccttctggggccacaggtcaggcaggtccaggccccaaggacctcccagtgacaggcgactgtgagctgggcagacaggagtgaagtcaggtgggggttctggcttgctgacaccagcgtttggagcctcctgctgctgcctggcttccctgcattccctgttccctgcctcaggcaagaaataaccaagccgagttgcctctgcacagcagtgagctcctggtggccctggcttctggggagccctgtggatggcttccttgcccaagtccaggccttcttgttccctttgtgtgctccagagaaagggggcagcaccagatccagatccagggccaaccaacagaaagctgagtccatcccaaactcgcccattctcagagcacaaagaccccatgatctagggcaaacttgtccaactgttggcccatggaacagctttgaatgcagcccaacacaaatctataaattttcttaaacattga

SEQ ID NO: 92878 - DNA, 497 bp, Homo sapiens
tctggctcggcccagaaccatgcaggtcacactgaagttttctcctagttatactgatgttgctgaagcttggatggtgggttttggggaggaagatgggtctgccatggttaagagggtagagaagttagagacaaacatgttgacttgattgttagaattgttgaattgatggtagatagagggatggagagatggatgaatagaatgaatgggcagaatggctaaatgggtagagggtgaatggttgaggtggttgaattgatagaggatgtgtagatgtatgaatgggtaaaatgaattaatggagtatgggtaggtgatggaatgattgactgatggaggattcatgcatggaacagtttgacttgattgtgaataggtcaatggatagaaaggctgagctggtatcagctggttccatggctgatcggctggctggacaaaacggctgactacatagagagtcatcaaaagctgatgttgtttagagctcc

SEQ ID NO: 92879 - DNA, 499 bp, Homo sapiens
tacaaaaaattagctgggtatagtggcacactatgctactcgggagactgatgcaggagaattgcttgagcctgggacttcgagactgtattgagctatgatcacaccactgcactccagcctgggggacagagtaagaccctacctcgaaagcaaaacagaaagaaagctgcagctggtggagaatgctaactccaccctcatacaattagaatatatgagaagtcttttgctactaatagatggtgcattccaggagtgatttagagctatgaagtcatatcaagatttacttttttttttaagatgactaaaattttcagagcaagcttgtgatccaatgcatttatttccacaagatggtgctatagcttctgctaagtacaaaactcacatttcctttaggaactagaaatacaaaatatgtttctaatggagaaccaaatgtgcatacgctctggtgagtctgtcaaagaaacacattgtgcaaaaacgtccc

SEQ ID NO: 92880 - DNA, 467 bp, Homo sapiens
agccaactactcaactaacccagctactccagaggctgaggtaagagggtcaggaggcagaggctgcagtgagctttcatcacaccactccactccagcctgggcaacagcaaaacctcatctcaaaaataaaaataaacaaacaaacaaaaacccaagtaagcaagtgaaataatgaagacctgtgcttcttttatcttcaggaaacaaattgaaattgaggttttttttttacaagtgatgagtaagaggaactgtaaattttccaaaaaatcataatagatttcaaatcaagtaaatttattgcttacagagatctgacttttcttgccaaatatgctcatatctggctaggtgcagtgacatacacctgtaatcacagcaatttagggggctgaggtgggaagatcgcttgagctcaggagttcaagaccagcctgggcaacatggcaaaaccctgtctctac

SEQ ID NO: 92881 - DNA, 750 bp, Homo sapiens
  misc_feature (462)..(462): n is a, c, g, or t
  misc_feature (514)..(514): n is a, c, g, or t
  misc_feature (521)..(521): n is a, c, g, or t
  misc_feature (650)..(650): n is a, c, g, or t
  misc_feature (676)..(676): n is a, c, g, or t
cgagacagccaccaacaatacctgcttcccagtattcctgtccttgtgatgtctccttcacgaggcatcgggttgtctgtgtgaccaatggaataaggcagaaatgatgctacgtcacttccaaggctggcttataaaagacactgtcacctctgccttgttctttccaccttgggtcactctggggaaagccagctgctatgccgcgaggacactcaagcgtcctatgaggagggccatgtggcagggaactgaggccgcctgcccacatccatgtgagtgaccgtctggaagcagacctccagccccagtcccgcctctggaggactgcagcctgcacctggaccaaagccttgtgagagaccctgatcctaaactacccatctcagccgcttctggattcctgacccacagaaactgtgtgaaatagtacatacttgctgttttaaacaaaaaaaaaanaaaaaaaaaaaaaaaaaaaaaaaaaaaaaaaaaaaaaaaaaaaaaaaaaaanaaaatanaaaaaaaaaaaaaaaaaaccatgtcggcccgcttggcccattcgattttagactggggcaagtttttgcatgcggccgaaattcgggctcaacttgcccaatttgcccttttgggggccgttttacaantacattggccgtgttttaacaccctntggactgggaaaacccttggggttccccaatttaaacgccttggagaaaaatccccctttggccaagttggcga

SEQ ID NO: 92882 - DNA, 631 bp, Homo sapiens
cgagacagccaccaacaatacctgcttcccagtattcctgtccttgtgatgtctccttcacgaggcatcgggttgtctgtgtgaccaatggaataaggcagaaatgatgctacgtcacttccaaggctggcttataaaagacactgtcacctctgccttgttctttccaccttgggtcactctggggaaagccagctgctatgccgcgaggacactcaagcgtcctatgaggagggccatgtggcagggaactgaggccgcctgcccacatccatgtgagtgaccgtctggaagcagacctccagccccagtcccgcctctggaggactgcagcctgcacctggaccaaagccttgtgagagaccctgatcctaaactacccatctcagccgcttctggattcctgacccacagaaactgtgtgaaatagtacatacttgctgttttaaacaaaatgtgggggtgactttttacaagcagacagataactgcaacatagtctcaaccttgaatttcattgcaaatgaccccatcctgaccataacctcaatattcgctaagtgggcagaagaatggggttggggggtgggggcagtagatgacttcgggcagtaaaaatgtgtccagtcac

SEQ ID NO: 92883 - DNA, 435 bp, Homo sapiens
tccaatttcattccctgtctggctgcttattgacttctgcagcctgtattgacaacatgcaaccctgtttctgtctgcctgctcccatgcagcgacaacttaaaaaaaaaaaaaaaaaggaaaatagggaacatcacagctataactcatgccaaagaccctgttctggggccaggcatcggcctggaggcaaaatttccaagaaaaattagagatttattaggagaaaaatgcctgagtccccttccctttcttttggttatcctttctcttctctcagggccacagagttcatttggctacttcaaacctctgccccacatttaagcttccaaataccactttgcaccaataaaatacatccaatgtaaggcaaatggggaacagcccacccccaccgcagctcacatatcttttctttttaaaggtgagccg

SEQ ID NO: 92884 - DNA, 286 bp, Homo sapiens
cagatatatatataaaatatatattttaattctgccactgctgctgataaagattaagaccctcatctcaatttttttacttgtaagattttcactgtctataataattgagaagttgttttgtacagttacagtttgtttcaatgaacaaaatgtttctagtattattttgacctctaaataacagctgctacttttttagtcattgtggttgtattcactaaattaccaacctttaaaaataatctccttccttgatgctatgtctctattgtgggatttatgc

SEQ ID NO: 92885 - DNA, 439 bp, Homo sapiens
agggaagcagaggatggagacaggcaacagtagttggcatttctcctacttctcccatcctgaccagaagagacaacccctcaattagtaaaatacggcccacagtacaccaagccatttgccactgcttggctttttttttttttcttaatggttgggaatgcttgggttcgactatagaatcattggattcatcgtggaattggggctgagttgcagggagaaaaggggaacatgcaggaacttccctctccctccagtgacctcgtatggtctgttgtaggctcactgtgtcccttcactctggactccctcaagggttccaagtaggaaggcacagggaggaagtatcactaggggaggcttccagatattccaggggattgttgcttgggtcctaaaatctcagggttggaatagactcttggggcaaagtatt

SEQ ID NO: 92886 - DNA, 374 bp, Homo sapiens
cacatagccctctttacctttgtcaagctccagaatcccattttggtcattctttctcaaaatgtggacactttccacccttcttggtttctgtcaccccgtaccaggcctcttgctgttgaatgctcttgctatcctactccgactctaaatatttcacaccaggcaattcctccctcttttggcaggatatcctccgcacccaacttcaaatttaacacccctcattgagctttcctcttgcatgaatgtcctcatcaccctgctcagactccgttaccccatgccaagctgcactcacatgcagattcccttcctattacactgggttccaaatcccctttgctgtgccttcttcctgtgtggatgcttca

SEQ ID NO: 92887 - DNA, 320 bp, Homo sapiens
tagtatgtggccttcataaggttctgaggcagacagagtaaggagtactgtccttcaaaaggtcagagagtacagcaacaggaaaggcttcccagcaggagttatgttttaactgagactaacaacctaattgtaaaacaaaacaaaaacattttttaagtaaagtcctgaatttccccttgatcacctaagtaatgtgcccatgttggtcctctgccctggacctgtgacattctggactatttctgtgtttatttgtggccgagtgtaacaaccatataataaatcacctcttccgctgttttagctgaagaattaaa

SEQ ID NO: 92888 - DNA, 563 bp, Homo sapiens
tttgtctagctaagggtttttatttttttcaagaaacaaactcgggttttcttaatattttctattattttcctattctctatttctactctgatctttgttattcccttccctctgctaagtttggacttagtttgttctccttctaattccttgaggtataaagttaggttgagattgttcttcttttttaatgtaggcctttatccctcttagtactgctttttctgcatctcttaagtttgggtacgttgtgttttcagttttattcgtctcaagaaacttttcaagttccctttggatttttggactcaaaggttgttcaaaaggatatcatggtttagtttccacacatttgagttttcctgttttctattattgattcctaatggaattccatggtgagtggaaaagattcttagaatgatttggatcttcttaaatctgagacttgttttgtgacctacatgaactatactggagaatgtttcatgtgcacctgagaagaatgtatattcttttgctgttgtgttaaaagttccatacgtatctgttagatccat

SEQ ID NO: 92889 - DNA, 246 bp, Homo sapiens
tcaagagtttgcttgaatcttcaacatatctgtgtccccatagtttctctgtcttttttcaggaccaatttgacttcatcttctgattcaagttcaacaaaagcctcgccacttggtctgccttcttgggctggggctcccctcgtgtcccgcggcgggaggcggggggcattgggacttggttgggtcgcgtctcgcctggtttgagggtttccggggctctgagctcgcccactccgcctccct

SEQ ID NO: 92890 - DNA, 623 bp, Homo sapiens
gacatagggtctcactatgttgcttaggctggtcttgaactcctgggctcaagcgatcctcttgcttcagcctcccgaattgctgtgattacaggcacgagccactcactgcacctagccaaagatcagtaattttttgagcactgacataatgccacaagtgaaaacttctgcatttgacctcgtgtgacagatcaatcaaaactttgttttcatgcacgaaactactaaaaaaaattgcataaaactacattcggactatgtgtataaggtatatataaaacataagtaaatctcatgtgggtcccatccccaagttatctttacatatacgcaaatattcccaaaacctgaaaaaatccaaactccaaacacttctggtcccaaacattttagataagaaatattccacctaaagcagaacatgagtgtatgagtatgtgtgtgtatgtttgtgtgtgtgtggagtatatgtaagtataaatgtgaatatatgtattgtaggtatgtgtatacacacgcgtatgctggtttataggtaaaaatgagaaccagtggatgttcttgtcagcaccacattcataaatacatatacaaaaagatttgcataaaagtgacaacat

SEQ ID NO: 92891 - DNA, 508 bp, Homo sapiens
tcaggagtttgagaccaccctgggaaacatgggtgaaaccccttctctacaaaaaatacaaaaattagccaggcatggtggtatgcaccttatgttcccagctacttgggaggctgaagtggtaggactgcttgagcctgggaggtggatgttgcagtgagccgagattgcatcactgcactccacatcctgggtgacagagtaagactttctctctctctctcaaaacaaacaaacaaacaagaattcataaaaggcaacttttccctgagacaaaagtgagacagcatactttttttttaatcatatacgtttaaaatttgtattttgatgtggagatcaatagaagtggatttcaggattttgtacaatttttttctaaggttttaattaatttattgcaaaatgctgtgaaagggcatatgaatcatgtggtgtgcctttttcctttgagctggcaaagagggcttttgacacagctcctgtgttctcattgtggacttggccc

SEQ ID NO: 92892 - DNA, 160 bp, Homo sapiens
taatataatacatgaagttactgctgtgtcaggctctgggtttttttttttcctgttaccaagttcatggctctgaggaggtcgggtttggtttggttttcttctttgcagtataagtggaagtttttctctcatgtaaattctgcttctgcaaagatca

SEQ ID NO: 92893 - DNA, 275 bp, Homo sapiens
ccagctagattggagtgatatctagattcttagatgtgagtttaatcctttaatcatctggagagttcatgagccatgttcatgaggttcatgaggcatgtcatgagccatgttcatgagttcatgaattcatgaggcatgtttctatggtttaagtttgcaacaagtatccttgaacatgtcagatatacataaagccattatgtggatatttgacacatttaaatattatattcgtgaagaagttatttaaattatcttattcactgtgtatg

SEQ ID NO: 92894 - DNA, 427 bp, Homo sapiens
  misc_feature (420)..(420): n is a, c, g, or t
  misc_feature (422)..(422): n is a, c, g, or t
  misc_feature (424)..(424): n is a, c, g, or t
tgtctgcactctcatgtttattgcagcactattcacaatagccaacatacagaatcaacttaagtgtctatcaatgaatgaatgaataaagaaaacgtacataaaaacacaatgaattaccattcagcgataaaaggcaatgaaatcctgtcatttgcaacaacatggatgtaattggaggccgaggcgggcggatggcctgacctcaggagtttgagaccagtctggccaacatggcaaaatccagtctgtactaaaaatacaaaaaaattagcccaggtgtgtaggtgcgtggctgtgatcccagctactcaggaggctgaggcaggagaatcgcttgaacccgggaggcggaggttgtagtgagccgaaatagcaccattgcactccagcctgggcgaaagagcaagactctgtctntntngtc

SEQ ID NO: 92895 - DNA, 530 bp, Homo sapiens
tactgatttgtttcttgctctcttggagtcctgcgagggttgagtggccaccatctttttgaacatggagactccaggatccacagaaaaggcatactaccagttcctaactgcatctgccacatggggatacatacacacatgcacacatacacacacatacacacacacacacatccattgaagggacatggaaggctgaattcatagaagcccattgtcacaagtctacctatgtgttaaggaaacagaataaaagcagtattaaaaggggatggactcaaacaaggaaggcttcatgaaggaggtgactcttaagcaaagctctgaaacaggcaagggtcagggcttggcagagggttatgtcagcaggagaacttgccatgcttccccacaggagccccaggttaacagatatggcccccaggaggggtgagcagggagagaatgtagggtttgtagtggtttttgtctccatctggggaagagaacccagggtccactgcccagacttctccctaccatgcttc

SEQ ID NO: 92896 - DNA, 379 bp, Homo sapiens
aatttatttagaaaaacacaaactggtttacattgatctaaattcattgtaagcttcagcaaactttctttcccagatatcaaaatttgttgtcacatgagagttaaagggaaaaagctttcatagtttctcaagctatttaaaaaattccatagtttttgcttctggctctcctaacttttttaggttttgttttcatgataacattttattcaagatttaaatattattagccaggcatggtggcaggcacctgtagtcccagctagtcaggaggctgaggcaggagaatcgcttgaacctgggaggcgaaggttgcagtgagccgagatcgtaccactacactctatcctgggcaacaagagtgaaactctgtctc

SEQ ID NO: 92897 - DNA, 317 bp, Homo sapiens
  misc_feature (28)..(29): n is a, c, g, or t
  misc_feature (120)..(121): n is a, c, g, or t
  misc_feature (135)..(136): n is a, c, g, or t
  misc_feature (140)..(140): n is a, c, g, or t
  misc_feature (217)..(217): n is a, c, g, or t
  misc_feature (238)..(238): n is a, c, g, or t
  misc_feature (303)..(307): n is a, c, g, or t
  misc_feature (310)..(312): n is a, c, g, or t
  misc_feature (314)..(314): n is a, c, g, or t
  misc_feature (316)..(317): n is a, c, g, or t
gcctgtaatcccagcactttgggaggcnnaggcgggcagatcacctgaggccaggagttcgagaccagcctggccaacatggtgaaacccagtctctactaaaaatacaaaaattagccnngcgtggtggtaggnncctntaatctcagctacttggaagcctgaggcaggagaatcgcttgaacctgggaggtggaggttgcagtgagccgagatngtgcctttgcactccagcctnggcgatacagcgagtctcaaaaataaataaatcgaaggctgctgagcacagtggctcatgctttnnnnnccnnncncnn

SEQ ID NO: 92898 - DNA, 317 bp, Homo sapiens
atgaaggagaaaatgtatgcattagaagagacatgaaagctaaatgcattgtgggaccctggatttgatcttggactaaggaaagggacagtgaaaaaactagtgaaatttgaactaagtctgtagctaaattactattattgtaccaatattaatttcttgattttgataactgtattatgattattcaagacaaagcttggtgaagggtatacagaaattctctgtactaattttgcaactctgtaaatctaaaattattttaaaattaaaaaaatttaaatcttgtgagaattaaatacagggtcaaaaatttt

SEQ ID NO: 92899 - DNA, 2646 bp, Homo sapiens
aaaatgccaaaatattttaattttcttaatactgtcataaattgaattgttatttacatttttattttctattctttcactatatatagaaatacaattaatttttgtgttttgaacatgtatcctgcaactttactaaattgacttatattaatccttgtaacttttttctggatttcttagagctttgtacatacaaaatcatgtctgcaaataggacagttttacttcttctttccaatttgcctttttctttttcttgccttattcactatctgggtcttacaatacaaatttaaatgcaaatagtgagagtggatatgcctgctttgctttgtttgtgattttaggtagaaaacattaaatcttcaccattgagtttgatgttagctgtagattttttttataaccttaattggatgaggaagacttctattcctagttgttgagagatttagtgatgaaagagtgttgatttttatcaaatgttttttctgcatccatttaaataattatatggttctttttctgttttctattcatagagtagattatattgattgattttctgatgttaagccaaccttgcattctgagataaaccccacttggatatgatagatagtattctttttacatgttattggttcttatttgctatattttgttaggaactttttgtttctatgctcatgagtaatattgctctgcagttctattatcttgtgatgtatttgattttctaataaaggtaatgttagccccataaaacgatctgggaaatgctccctcctcttttatattttgaaaacgttggtgtaagattggcgtcatttcttccttaaataactggtggaattccccagtgaagtgatctagatctggagttttctatgtgggaaagtttttattattaatttaaatagggctgccaaattttcttgaggcagttttggtaaatttgctttttaagccgggcaaggtggctcacgcctgtaatcccatcactttgggaggccaaggcaggcggatcacgaggtcaggagatcgagaccatcctggctaacacagtgaaaacccgtctctactaaaaatacaaaaaaattagccgggcgtggtggcgggtgcctgtaatcctagctactcgggaggctgaggcaggagaatggcatgaacccgggtggcggagcttgtggtgagccgagatcgcaccactgcactccagcctgagcgacaagagcaagactccgtctcaaaaaaaaaaaaaaaaaaaaaaaaatttgctttttaagtagtattttatctagatcgtcaagcttatcagcatggaattgttcacagtatgcccttcttattcttttcatgtctgaaggacgtgtagaaaaaccccttctttcattcctaatggggatttgtctcctctgttttcttcactagtctggctacagctggtcggttttattgaatttatttcaaaaacgtggcttttggttttattgatttttctctacttcttttttttttttttttttttgagatggagactcactctgtcgcccaggctggagtgcagtggcacgatctcggctcactgcaagctacgcctcccgggttcacgccatttatcttttctattttattgatttttaccctttatcctttccttccttttgtttactttgagcataacttggacttatttttataatttcttaaggtggaagcttagatcactgagctttatttttagactttgcttcttttcccatgtaggcattaaagctacatatttccctatatgttctgttttaccctacatcccacaaattttgatatgctttcattatcataggtatatgatatattatcaacatattttctaatattacttgtgactcttctttgatctagtgattattcagaagtatgttgaagtccagatatttgaaattttcctggttatctcattattattgaattccagtttaatcctttgtggacagagaacatagcctgcgtgattttaaactattcaaatttattgagttgtgttttgtggcccaaaatatggcctatcttgacaaacacaccaggtgcacttgaaaataatgtgtattctgccatttttggtgaagtgttctataaatatcaagtcaagttggttgataatattgttcaaaacttctatgtctttactcattttctggtctaattgttctagtagctgctaggtagagatgttaatatttgcagtgatgtttgtggaactatctcttctgcactttcattctgtcagttacttgcttcatgtatttttgcttcatatattggatgcatacaaatttcgactgttgtgttgtccttgacaataagacttttatcattatggagtaatgaaattgataatacatttcttattgtgatataattgacagaacataaaatttcatacaatataaaattctccacttaaaaatatgcagtgtacattttggcttaagtatattttgtctgatatcagtctagccagtctagccttttgatgtctactgtttgcatggtgtatttttccacccattttctttcaacatatttgtcaatatatttgctggttcttctctaataaacatatagttgggtcttgtt

SEQ ID NO: 92900 - DNA, 702 bp, Homo sapiens
gtggacttctccagtgcctcccttttctgaaaacactatccctgtggttgattcaggcatctaggctgaaaacctcagatctatttgtctcttttgtccctgtcaccaaacccaccttcttctccctttgcagggcctcttgcctattgttgcttcacctgtttctattagccttttctcgtgtgcctaggcaaccgcaaaggtctcctaattgcttcttctggcttggtctcggttcccttctccaggcctttctttcgcaaagtacaaatggaatctttctaaatctagtttccctgtctaattttaaaaagcccagtgatttcctctagggattgagcaatggcctccaaacttttatgctgataaaccccataggcagcattgagcctgcaccactgatgcatttatttatgaattatatagcttattatttgactaatttgtcatatataaactgcattaaaataagggcttttttgaatgagataaatagaaatagaaattctaattttcgtttcatacccagactccctgggttttatgcgccctacttagagaccactggcctctcagttcagacttgagctggtgtacaagccttccttagtctgttcccagccttgtacttcactgcatccttctgagtcctctgcctcaagctgttccacttactggcatctcagtaatgcctttcccacc

SEQ ID NO: 92901 - DNA, 713 bp, Homo sapiens
ggagcacacagtcatgggacacccaggcttacagggcacacaggctcacagggcacacagtcacagggcacacaggctcacagggcacagagtcaggggccacacaggctcatggggcacagagtcacggggcacagactcacagactcacagatcacagaggctcatggggtgcaggctcacagggcacacagactcacagggcacacaggctcacgggacacacaggctcacagggcacacagagtcatggggcacagaggctcacagggcacaggctcacaggcacaggctcacggggcacagacttaccggacacacaggtcatgggacacagagtcatggggcacacaggttcacagggcacacaggctcacgggacacagagtcatgggacacacaggctcacagggcacacaggctcacaggacacacaggttcatggggcacagagtcatggggcacagactcacagactcacaggtcatagacgctcatggggtgcaggctcacagggcacacagactcacagggcacacaggctcatggggcacagagtcacggggcacagactcacaaactcacaggtcacagaggctcatggggtgcaggctcacagggcacacaggctcacagggcacacaggctcatggggcacagagtcacaaggcacagactcacagggcacacaggctcacaggacacacaggctc

SEQ ID NO: 92902 - DNA, 259 bp, Homo sapiens
aggatggcaccactgcagtctgccggggtgacagagctagactctgtctcaaaaacagaaaaacaaaaaaacaactttccagtggcttctcactgctctgagaataaactccaggctcttccattgcaaccaacaggatctggtgattcgaccccagcccctctttccaggccctcatcaccttgatcctcccttaacctatcctgctccagctgcactggctgccttcctattcctccagcataccaagattgtttct

SEQ ID NO: 92903 - DNA, 826 bp, Homo sapiens
cacaataaataaaacagttgctgtcaatacaactccccttattttctctcaagtcacctggatcgtcctgaccccgggaaccccgtctgcagcaccaggccccctccgtggagaaaagatggagccggattaagcacccagtgctaaggcgactaagacgccactgcccgcagccctgccgaaaatactcagagagtgcagcaggcgccgcgattccttagaaagtgctggcgtggctctcctgacacagaaagccggctcctggatgcttacaaaggactggcccgcgcaacactgttgctcctcaacccgggccacactccaaggacctctactgagcttcagcttgctcaccgaaaacggcgcggccccctctacccgggatgtcggagcccaggagaccctgagagcccccagctctttccgtaattgcaggagaaggggcaagcgggtccgtagccgggggccctccagtggcattatcctgaaccgccacgcccgcacgtggcccggctagagctccctggcgaaggatcacctgttcctacagtgacaactggacctggcccgaacccctggcatctggcaacattattacctgtcgaaacagaagtagagatttgaaatagaggatgccagttcccatttcctcctgctgtctggaaggaagtctggctttccagcccaactctaagctcatctttacatacaaaataagggtatgtttacatggaaagcaaaaatagaaccatggatttacagaaggttccatagcagcaaataacagtgcttatgaaataaacattttaaatattaaaatgtaaaa

SEQ ID NO: 92904 - DNA, 406 bp, Homo sapiens
gagatggagtcttgctgcgatgcccaggctggagtgcaacggcgcaatctcggctcattgcaacctctgcttcccgggtccaagcaattctcctgcctcagcctcctgagtagctgggattacaggcgtgcatcaccaagcctggctaattttttttatatttttagtagagacagagtttcaccatattggctaggctggtcttgaactcctgacctcaagtgatccacctgcctcgatctcccaaagtgctgggattacaggcatgagccaccgtgccaggcctacattttccttttttaaaatataaagttatatttcacttaatactagtatgattgagcttttaaaatatgtttatattacagactgaattgtgtcacccccaaattcatatgttgaggcc

SEQ ID NO: 92905 - DNA, 364 bp, Homo sapiens
ggattaaataatgtgcagaaagggcctagaatagcacctggtgcaaagtcaatccttaatacatggtgcctattattataacaaactctttttgataccattggatgaatttcaagaaggaccaacctacatgtaaagtgtattagggtgacattttggagaattgtctaggaaactcccaccttatatttggtgtcacttggattctgacagccaaatctatgttcccaatttcaaaatcttcttttggccaggtgtggtggctcacacctgtaatcctagcactttgggaggccaaggtgggtagattgcttgagcccaggaatttgagaccagcctgggcaacatggcaaaatcctgtctc

SEQ ID NO: 92906 - DNA, 735 bp, Homo sapiens
tttttttttttgagatggagtcttgctctgttgccgggctggagtgcagtggcacaatctcggctcactgcaacctccgcctccaggttcaagcaattctcctgcctcagcctcccaagtagatgggactacaggcgcaccaccaccacgcccaggtaatttttgtatttttagtagagacaaggtttcaccatgttggccggcatggtctagatctcttgaccttatgatctgcccacctcagcctcccaaagtgctgggattacggtcatgagccaccgtgcccggcccagtgttgctaactcttatcagtaccacctctaaactctgatgttgtgattaaaggaagagattcccgcaggcagacttactaggtttaaatttcagctctatcagttatcaatcattatgagttggtcacaatccttaaattctctgggtgtcattttttctcatcaataatacaggactaataatgcctactttatgtagtttaaattttacccaatagtaatcaaatccacaaacctttactctctaactagcctaatctgaactctcaaaatacaccccttatgaaactcaccacttatctgttgtgtgttttatccctcttactaaactgtaagctccttgaaggaagtatttacctatgtccccttaaagactagcacagtgccttaccacagcaagtactgagtaaatatttgtttttaacaggttaattagtaattt

SEQ ID NO: 92907 - DNA, 405 bp, Homo sapiens
attaggttgtgtgtgtcaagctgccattataaaaacactaaatgaataaaatttcgcaagcaaggcagcattatcaggctaagtacatgtagtgggcttatatatggtgatgttttacataattcagctattaattcatctatagatttacatttcttaagtgcaaaaaaaaatgtaattatttcattacatatggaattcacctcccaaatttctcagaatctaagagaaaggattgacattttctgatatttcatttttgcttaaaattaagttcttaggatgtttagattttattataaatattacaacttaaattccagagttataatgaacggtctatgttttgaaacacagagggagaatggggtaatgactgaagtactgttttttcagtttattagt

SEQ ID NO: 92908 - DNA, 277 bp, Homo sapiens
acaagtaagtattttctgtttgtttccctttcctcaaatggtgtaatatattaattcagagctattaaagaaaaataatattaaatattgaatttaatactcagacattaaaatgaaataaatcatttaaacttaaatgcatataaatgttttcttttcaaattaatgtacttatatttccccagtaaatttcctggaatttgccattgtaaagattaaattctaagaagtatttgtttcgatatttgtgtgctaattaaagttaataatgaaagat

SEQ ID NO: 92909 - DNA, 472 bp, Homo sapiens
ctggcagatttggtgtctggtgaggccattctcttcttccaaaactatgctttgcagactctggagtggagaaaggctggttactcagcaaaaggcagaagaaccaagagacaaaaaggggttgaacctgtccttttataacagcattaattctacccaatcacatgttaaatgtcccacctcttaatactgttacaatggcaatgaaatttcaacatgagttttggatgggacacacatttaaactatagcagatgggatgtaagcatgagcaatttggaggcagaggagacaatattttatttgaaatgcctatgtgccatggaaatcaagagacactgggtaagtggacttacggagctgaaactcaagaagagatagaggctggagatagaggtttgaaaatttatcaacatccataggtgatacatcaagcgtttggtgtggatttggtaccaagtgagaagaaatg

SEQ ID NO: 92910 - DNA, 493 bp, Homo sapiens
ggttcaagcaattctcgtgcctcagcctcccaagtagctgggattacaggcgtgcactgccacgcctgaataatttttgtatttttagtagagatggggcttcaccatgttggccaggctggtctccaaagatcagccagccttggtctcccaaaatgctgggattacaggaatgagccaccatgcctggcccagaaccagagttcttaatggctgttcggacttaaaacatggtaccccaaactatgtaaccttggtgtgctgaaaactttgaactgaaggagattgggagggcctcagaagcaaggtccttctgacacctcactctcctttcttcctcttatcttccctaagaattcctcttttcctgcgtaagtcatagaaacaacttctctcccgcaaagcaagtcataaaacctagagacgccactcccctgaaggtagaaaaccctcattacagaggagtcctgtcccctatccaggggaaagaatg

SEQ ID NO: 92911 - DNA, 317 bp, Homo sapiens
aaagacccttccatattaatatatagagataaaacatgattttaatattggataagcattatcagagttatatgcatgtgaagtagtacaaaaacaactacaaaatctggaaataatttcacacacattcatacaaaaaaagtagaagagagaacaatttaaaacttctcattttcttgagatacaagaggatgcacattgtgcctgtctcacttataccttaggagagatccctgagcaaattctagaagtatttgcatttccaagggtcagaggcacatgaacttgcattgtaaaatcaaaaggtcaagactttt

SEQ ID NO: 92912 - DNA, 404 bp, Homo sapiens
tctacttgggcactagaaaagaaattgtatagttttaaagcagatgtatgctcttaacgtggttggcttgtaaagcaataaaacttggggtttttccccccttagcctatcacaactcttagaataaacagtgtacttaagacagggcgattctatcacaattccatgtaatatttagtccatataacaagataaaatttgaattagcatcacatatagaaggcatttcattttctcacatacagtacaatattaagcgcaaacaacatatgtctccatggttataaacaacagcgtcatgtttgcaaaacagatcctatatgtagaacgtctgtaaatgggagaaaatatggggcttttgttggttaaaatgatgttaaatatttcaagtcgcatgatcttta

SEQ ID NO: 92913 - DNA, 209 bp, Homo sapiens
acgggagggacggccccacactcctgactcccttgtccacgtgcaagggcacctgtgagtgcatttgcatgcttatctgcatgctcatttgtatgcttgtttgcctactgatctgcatgctcgtttgcatgctcatctacttgctcgtttgcgtggtcatctgcgtgctcgtttgcgagctcatctgcgtgctcgtttgcgtgctcgtc

SEQ ID NO: 92914 - DNA, 455 bp, Homo sapiens
tagcacctgagtgttcctttaggatgcatgtcagtcataacctacttgtttcatctttcaaaattctgtatcttagattccaaagaatgtgacagtttctcccaccagcagttgcatagtctggtagatgactgttaattttccaagagagttgatgagttgtccaggggcattcacatctttggcccttttaagcctgtagattagtgcttctcaaacttttttttcattatccctctttccttgcccagagagcctctgttagaccttgtttttccctaattgctccccaagtcgaattctaatatcatagaggtactgtacatctggtcatgtgctatatgtatatttgtgtgctttatatatttaacaagtaagatttctttcaccttccccaaagaaccaatttttatcccctttggggtgatacttctgctttgagaatgcatgccatg

SEQ ID NO: 92915 - DNA, 422 bp, Homo sapiens
aaagctgttaattaagatataatttatatttatgaaaatttgaaaacaactaaggtcaagggagtggctaggtaacagactaactattggatatgatgttcattaacaccatgtggctcacccagaaaatgcttatgatatgcaacaaatgaaaagcagaaaaccacatttaacatgcgttatgactacaaataagacataatacccacatggggacatggatcagaagccaagtacaaaagactaatttattagaaaagctagctttgcaatcctttttcctttttaaaacttgcaatggatataaactttatatggaacaaattctttaaggatgcatgtatctaatcctctgtgatacaacctgagaggcaaaagcccttgctgtcagacaggcctgtgttgaaatcttcgttctgttg

SEQ ID NO: 92916 - DNA, 323 bp, Homo sapiens
ctctcagatttgcccagcttgacatgatgttatttttcagagggagcagcctctattcagctcctagtcacagccggccttttggaacattctttctagcatttgaaggtttctaagaggtgggagggggtatcttttatactgggaccctttgagtaatctagctcatgcaaggcattcctcttcatgaaggactgagctacctgacttctgaccagaaacaaacgatttttttttttccttttttgaccagaaacagatggtctgcttgagcccaggagttccaggctgcattgagctatcatcgtgccactgcactcctg

SEQ ID NO: 92917 - DNA, 397 bp, Homo sapiens
ctactactactactaaatttgcggccgcgtcgacagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaact

SEQ ID NO: 92918 - DNA, 258 bp, Homo sapiens
aaacattacagtgaggatgtagaagttgcaaattggcacaaatctgcctggagacatgttttgtttgtctcagtaattttaatatttactgtagttaccaaggttttttaactttcatgaaaatgaagatttctggctgttttggaagaatgggaagaactgacaccactaggtccacacttataaatgaaaataactgagtggaatggaatagcaccgccttctccaacagagaatgtgctctctgattcttccaat

SEQ ID NO: 92919 - DNA, 364 bp, Homo sapiens
ccttgcatttgctgtggcaggagaaaacagctagagaatcaaagaggattcctcaatgcctcagcctagaagtgacatgcatcccttctgcttattgaccatgtccaagtcacatggcccagcccaattcaaggaggctgggacatacagattccagtatgcccaggggtgaaaggagaaccagtgattagtgagctcataatgtttaccataatatctattttatgttactctagatggctgccaggtcatctaacattacttattgcataacctatttttttctcattgatttggaatgctatcttggttatacactgaaagcttctgtatctttccattttcccctgagatcattgacttt

SEQ ID NO: 92920 - DNA, 433 bp, Homo sapiens
aaaaaaaaaaaaaaaaaaaaaaaacacttgaggctgtccttaacccctccatctcccttacctcccatgttaacttaactcataatctttatatggccttttcttttcacctctattgccataaccttgtttgaatccttgcagtctttcatctttactactgctacattctctctttcaacagctagtccccactgcctctcaccctccacagtctccagctttatattccttaaaaaaagaaaaaaaaaaaaggtcaggttacttttcccttctatgaaaagctctctacaggaccactcttttcaatactaattaaagaacaaactatttagtttgacacagaagacattctcattctgaaaccccaagctggccacttactgctagctactccacccattctctaagggttctatttccattcaatttg

SEQ ID NO: 92921 - DNA, 1916 bp, Homo sapiens
  misc_feature (169)..(169): n is a, c, g, or t
  misc_feature (1717)..(1717): n is a, c, g, or t
gtatcttccacaatgtgacacagcgccttatacatgtgttcatatgacagcataaatatttgtggatttgtaagtgaaacaaaggctcatttctccactcataagatccaggagacagaagtaagggtaacagcgaaaaagccttccctgtaggtaggttaaagttttncgttaagagccaaacccatgtctaaattaagtaggaatccagaagatttttcatctcttctcttaaaaatttttaaattctgcccagtcacagggaataatggattgcagttagactctctgccagaggctccctcactcagaaaacacaagttccgttccatgtccccaatgcacacagaacaacgagaatctttatattccactttcatgaagctttgcaaacctcagtaagaacaaacagaaatcccatttattctagtattaactgcatactataatacgccaatagtgtcttaggagttagaaatatacaatagtggacaaagtttctattatcacggagcttatatactaatgggaggaatgtaatcagtaaacaaatgaacaaatagatggtggcaagtgctaaaaatttcttagctcttggaagggatggagctatgtgtttgagggaggttgctaggaaggagccccacataaaatgacttttaagaattatggcaacagtggtagtgtgtcaccagtggcctggaggcctatggaactgaccatcatgatcaactaccaccttccacatagtgagtaagtgtgaaggcctcccattcattctatatctcacatgtctgctccacctgtgccaaaccaaagacacatcaaacgggatcgtctcttggtaattttgcaaagcctctagttttacgtatatagtaccagacggtggaaatctcatttatttattcacatgcttcacaattaaaacaatctgatcactttaagtgactcaaaattacacgagccatttattacacgattaagtgacgtaactgtagctagtaagcatgtgaagaccctgtaagccaggggttcccaacccccaggccgtggaccattactggctcatgacctgttaggaactgggccacacagtagctggtgagctaggaagcattactgcctgagctctgcctcctatcagatcagcaggggcattagattctcataggagcgcgacccctattgtgaactgcacatgcaagggatctaggctgtgcactccttatgagaatctaatgcctatgatcgaggtggaacagtttcatcccgaaaccatccctccacacaccccctgccagtctgtggaaaaactgtcttccatgaaaccactccttggtgccaaaaaggttggggaccgttgctgtaagccactgagtaacaagtgaaagccatttctgaaaaatcatttttcaaactgctggaaaccaactgcagtaatggcggatgtagcaccaaataataacctatctacatggctttaaattttgaaataatactctctaagtggaaaatatgagcaattttaatacattattaatatatcactataaaataaagccattaataaatcactacaaaataaagccagagttatttttcctaataagtttaatattacgcctttaagtttctacaagaaggaaaaatcaccaggattattctacaagaagaaataatcaccaggacaaaaaatatctctatcctcatacanctcataaccatacacctgttcttataagattcctagaagggtacagtggtatgcacctgtagtcccagccactcaggaggttgaggtgggtggatcacttcagcccaagagtttgaggctgtagtatgcaatgatgacaactgtgaatagccactgaactccagcctaggcaacatagtgagaccctgtcttgaaattc

SEQ ID NO: 92922 - DNA, 751 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaacttgaaatgaat

SEQ ID NO: 92923 - DNA, 1116 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcac

SEQ ID NO: 92924 - DNA, 321 bp, Homo sapiens
accacactgaaacaaggcatttatctacagagctcaactagaaccccttttcattgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92925 - DNA, 471 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaacaagtacttgtgactcaggagactacaacatggccaaagaacgtgacggagacagcagctgcctcaccgcccagacatgatctggtcagatgtttcaatgcctcatgatacaataaaaccacaaaaattttcttacccc

SEQ ID NO: 92926 - DNA, 351 bp, Homo sapiens
tgatgttggagcggccgcaaatgttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaacttgaaatgaat

SEQ ID NO: 92927 - DNA, 4013 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92928 - DNA, 3955 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcatcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92929 - DNA, 3942 bp, Homo sapiens
ggtggaggcccgggggttaatcggacgaggcggtggcttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92930 - DNA, 4106 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92931 - DNA, 4061 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92932 - DNA, 4169 bp, Homo sapiens
gtttctattcctggtctgggagaataatcattttgaggttgttggcttgtggttgatctcctggtggctaggatagccccatatttatccttctctatatcttattcatttctgtttctccagttccaggctattgccctgtacccagtaaggtcctcagttaccctttatgaataagtgattttggtggaacgatcctctactgagtggagtacaaaggatggcaggggctatcccttgactccaaaactatatactctagctgggaaattgcttatgtacctgaaaaagtcagaacacactggggagaagacataagtacatgtaattaatgttaaactgtgtatgcatgaggttaatcaaggaagacttcttgaaagatccgagtgtgcatgagggtttataatggatgtgagatgtgagtctccttgtttttgaggaaggccagagtcctcactcacctaaacctccctcttatctcttagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92933 - DNA, 3576 bp, Homo sapiens
ggtcatagcgttccagagtgaaaccctatgtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92934 - DNA, 4546 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaagaaatattctgaagcagttggtgtgttttattggggtttgggagggggaagaaaacaatactgaagacattgttaatgtgagatgcggctgagttccccaataccatcacttaggaaagggagcaggaatgttggcataaaccttgcccatccctttgtttctgtaaccaatgtagaaggtgcatcaacctcagtttgtggctcacaaaatgaggcatttaagatatttgatctaaatggtttcttgacacctaagcctagtccaggtttagcagaaaaggaggcccagtctccttttccctctgtcttccattccttttcaagttcccatgtttgtgagggagaaatgtgacaaaccaaaagaaatatattatttctttgtaataagccaaaagaaactcaagtctttctgctggtggccagcaggaggcagagtgatttctttcctcatgatgtgccaatctgcattgctggaaacctgctactgaaagaagttaaaagctgcctgtgaatgtaacgtacaaaagaaaggt

SEQ ID NO: 92935 - DNA, 4429 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaaaaaaaaaaaaaaaaaaaacaaaaaaaaaaaaaaaaaaaaaaaaaaaaaaaaaaaaaaaaaaaaaaaaaagggggggggggccccaaaatattcccccgggggggccccctcgccgacacccaccagttctgttgtgtgatgaaagaagggggcccccacaaagaggaggagcgcctcgtatattaataaggacgagagaccgcgaggcgcgcggtgactttaaaaaaaacagcagactggtgcgagtgcggagaaaagaagacgtgtagcatccgcgggagcgaatactctgtgtaggagaaagagcacccccttacctactcggtgaggggggaggaagaacaatagactgtgggcgacaacgaccctctcaccaggaacagtagtatcaagcgcccccgaggaagggagcacag

SEQ ID NO: 92936 - DNA, 2857 bp, Homo sapiens
cgcgagcggcgctcgcgatctagaactaggcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92937 - DNA, 2567 bp, Homo sapiens
taaatcgagctcggcccaatgttgacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92938 - DNA, 2278 bp, Homo sapiens
tcgctcgttgttgcccaggctgagtgcaatggtgcaatctcagctcatcgcaacctctgcctcccaggttcaagcgattctcctgcctcagcctcccgagcagctgggattacaggcatgtgccaccacatccagctaactttgtattttgagtagagacggggcctctccacgttggtcaggctggtctcgaactcctaacctcaggtgatccgcccacctcggcctcccaaagtgctgggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92939 - DNA, 2540 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtaaaagagtaaaaaaaaaaacact

SEQ ID NO: 92940 - DNA, 2548 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtctacaacacaacacgcaaacccagcacacag

SEQ ID NO: 92941 - DNA, 1116 bp, Homo sapiens
ggacgtggggcgggtggttggaaagacggtgaatggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92942 - DNA, 1279 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92943 - DNA, 1789 bp, Homo sapiens
cataactgggaccgaacctctccatcttctcagtcaattgtatcacatatacctgataactctatctctattctgtaccatacatctcctcatactactttagtatttcctccaacattttctttgcagcttctgcagatacagcctttatacgttccacttcaatcgctttttccttttctgagagtgactgatcagtctgtagaagtgcatcagccacatcctccttggactccaaatattttttcagcacctctttggcctgtatccccttccttggcacctggtagtacacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92944 - DNA, 1162 bp, Homo sapiens
catggtagaatcagcatatgaacaataagaacaataggtaaagctatgattatggcgtatatataggaaatgactgcattggatatttaaggatattttgctaggttctcccctttcattgtgatactcttctagttgagacattttatgatagatttgcactcatagaaggaaacgtctctattctaggagggcaaaatacttgtgtgctcatagctttcaccgtgagctataccaatctacaactggaagatacataaaagtgcttagcattgaatttgggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92945 - DNA, 882 bp, Homo sapiens
  misc_feature (777)..(777): n is a, c, g, or t
  misc_feature (779)..(779): n is a, c, g, or t
  misc_feature (782)..(782): n is a, c, g, or t
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaacatttggggtgacngntgncgcgtgactttttaatcccatctattttccaaagctattctcatattaattccctttatccctcgactataaacgttgttattcgctttaacttttccat

SEQ ID NO: 92946 - DNA, 767 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92947 - DNA, 808 bp, Homo sapiens
ggacgtggggcgggtggttggaaagacggtgaatggaaaggggatggctggtggtcttgggtgtgatgtgtgttattggtttgtagaggtaagtgacccagcaaccgggctggggcccgcagcctcaatccgcaaagataggggtcgaggtaaagacgtttaaaaaaaaaccagtattgggggaggggagaagtgtagttattataatggctagtttaaggcggcaactttctcaagagacctattttagtagctaaggatggtctattgctcaccttcagtgaggacccagcaatattgaagagggctagagttccaaacagaatcatggtaattaaacttggaaaagacgccgacagggtcgtgagaaagacacttctctcttcccctagacttccaaggcagggacttagtgcacctgcgattccgtgatggaaacactaacgccaaataaaccccttattggggtttgtatttgacttttaaaatttagtactgggttcaggtactcattaaatacacttggtgttatatctatgcgtaatttccaagagaaaggaatataattccactaaaaagagtcatacgttgacttcatatcttttcaaaaagtcactaaagggcagcagggaccacaaaaaaaaagcaagcttatgcattccggccgaattcggcttacttggccattcgccctttatggagtcgattacaattcactggccggcgttacaacgtcgtgactgggaccctggcgtacccactttcgcttggagacattcccttttccagttgggtattacgagcccac

SEQ ID NO: 92948 - DNA, 236 bp, Homo sapiens
cgtgccactgcactccagcctgggcaacatagcgaggctccatctcaaaaaaaaatttttttattttccttactctcctctgcaatgactgtaggattataaatcattacattggagtgtgcttctctgtgcggatgaaatggtgggtgaaacatccctgtggaggatcccagttattgagtcttagtcacagatgataatgtgatgctgatttgcatttaccttgctggaggcaa

SEQ ID NO: 92949 - DNA, 1231 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92950 - DNA, 2517 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgt

SEQ ID NO: 92951 - DNA, 606 bp, Homo sapiens
gagatgaggatattaactcataataaatttagggttgatgtggcaaggtggaaatcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaacttgaaatgaat

SEQ ID NO: 92952 - DNA, 3898 bp, Homo sapiens
ggacgtggggcgggtggttggaaagacggtgaatggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92953 - DNA, 4044 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaaaaaacacggcagaccacgaagcaaaaggggg

SEQ ID NO: 92954 - DNA, 5355 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaatcgcaaaaaaagacatagaaaaaaacacaaaaaagaatagacagaccataaaaaatgtactagaaatacacacataagaaaaacaaaaatagataaatagtgcgcaggtcgtgcccacacatgtttcttcactgagtggaggccctgaggatccaggcaccccatggtattgtctttctgctagggagtggtcgtctaccgtgatggcgttttgaaccagtagtcggtatgcgtccttgagaaacaacttgctcttgaggctttggcacaacaacttggcttgaggaggcagcccctatcttgtcacatgaaccccagcagtcctcaaggttgagtccgtggacacccacaagtggtggagccaagaagctccatagggagaacaatagtaatcgagagtagcgagcgatcatagagagttagatagctgaggtttcaacaggatcgaggaaattcgcgagatctttcccatgagacgctaggagatacaataacgcccttagccatagacatagacacccagttgatcgtcattcatataagagagatacacctttggcttggagcacccaaagaacaaggagaccattatttaagagcacataagagccacccacttttattatcatataaagggccgatggtagcagaagtagttgtaccagtagatatatttatatagacgcagttaacgtttgggcgcagattaaggaatttaaccccctttaagagggcccccagaaggggggcccccccacatttggaggcgcccccgaaaggaacctttcgagacacgttggccccaaaccttggggtttcgaccggggcaagaaccgggactcggttagcaacggttgcggcgcccttgggggaattccccagatcgagggcattttcgcttaaacacgtttatttacccccgcttttatcgcacaccgtatggaaagagacccccctatggggagcgaaagaaataaaattgggagagcaagccagagaggagcgtacacaacaactggggcacaccggctatacacttcacacacatcttactggagggatgatctaaacagacatgggtaaacaggcctttggacgaacattctcttcccgccactttttgcacaagctggtttccaagcgacgccccccctgatgctcccatatgtgtcgcatgaaagcggcgccgagagggcacttcttgcccatctttaacaatactcacaggcgaaggaccactccatgtggtcttgacagaggacaataattgacaaggggcgcgaccacacggatacgacccatagaataacccacccacaccccaaacacgaggagattttcc

SEQ ID NO: 92955 - DNA, 3967 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgcccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgctgtaaccagacacatgcacgtgatcgggatcctctaagcacta

SEQ ID NO: 92956 - DNA, 1262 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaaaaaacacggcagaccacgaagcaaaaggggg

SEQ ID NO: 92957 - DNA, 2494 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgtggagatccctaccatgtggagagccacta

SEQ ID NO: 92958 - DNA, 1063 bp, Homo sapiens
agacctgcggtgtaaatacgtggacgtggtgcttggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92959 - DNA, 1257 bp, Homo sapiens
ctactggatccttttctggagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagaggctccgacttcctcatgaagagactccagaaaggggtatggggcatagtctcttaccctctttctttggagctaaaggaggttcttcgaatgaagtctgtagaggttctactggatccttttctggagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaa

SEQ ID NO: 92960 - DNA, 865 bp, Homo sapiens
cgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaacttgaaatgaattttcgcttcttccctcatgtgtgtatcccttcttcctcgcttctacaaatccccgctctttcagctctctatgctctttctctctgcttactttgcctttctctcgtccctccg

SEQ ID NO: 92961 - DNA, 588 bp, Homo sapiens
cttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccaggactgaggcctgccccatgaagaggctgagccccctgaaacccctgccccttgttggtacattccagagacgcaggggcctgggggatatgaagctagggaagcccctgcttcgattccccactgcccttgtcctggatccaacaccaaataaaaagaaacaagtgaagta

SEQ ID NO: 92962 - DNA, 402 bp, Homo sapiens
cttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccaggactgaggcctgccccatgaagaggctgagccccctgaaacccctgccccttgttggtacattccagagacgcaggggcctgggggatatgaagctagggaagcccctgcttcgattccccactgcccttgtcctggatccaacaccaaataaaaagaaacaagtgaagta

SEQ ID NO: 92963 - DNA, 425 bp, Homo sapiens
ggcaggccttgcttcctgcctgtctgctttcccacgagagaagtcagagatgcagtaggcacagtggctcacacctgtaatccctgcactttgggtggctgaggtgggaagatcgcttgactccagaagctcaagaccagcctggacaacatagcaagaccccatctctacaaaaatacaaaaattatacaggtgtggtgttgtgtgcctgtagtcccagctactcaagaggctgaggtgggaggatcacttgagcccgggaggtcaaggctgcagtgagctgtgattgcactactgcactccagcctgggcaacagagcaagaccctgtctctaaaaaaaacaaaaatgtaaaccagacaaaagcacaaaacagtgacaggatgcacgcctgggtgatcagggaagacgcagccatcctccagc

SEQ ID NO: 92964 - DNA, 347 bp, Homo sapiens
ttttttttttttttgagacaatgtttcactctgtcacccaggctggagtgcagtggtgcaatcataggtcactgaagccttgaactccagggctcaaactattctcctgccttagcctcctgaataactgggactacaggtgcacaccaccatgctgggctaaattttaaatttttagtagagatggggtcttgctatgttgcccaggctggtcttgaactcctggttttagacttcagcctcagcatgccaaagtgctgggattacagggatgagccaccatgctaggccaaactcaaattctttttgaggctagtataatgtagatatcaaaaattcaaagacag

SEQ ID NO: 92965 - DNA, 406 bp, Homo sapiens
acgatgttaatactttaatgccactgaagtgtattctaaaaatggttaagatggtaaattttatatgtatttaccacaatttaatgataacaataataataataaaaaggtcactggctagagttgttcatcctccaactaaaccattcttcttaatgagttaaattctccattatacggttaggctgtgtccccacccaaatctcatcttgaactgtagctcccataattcccacatgtcatggaaggagcctggtgggaggtaattgaatcatgaggcacgtctttcctgtgttgttctcatggtagtgaataagtctcacgagatttgattttttttttttttttgagacggaatctcgttctgtctctaggctggagttcagtggtgcgatcttgattcact

SEQ ID NO: 92966 - DNA, 483 bp, Homo sapiens
catttaaattttgaggaaaactgccagcaccattgaaaacaaaacaaacccaaagttgactggaatcttaaagaaacacagtgctcctcaagttttcaaaatgaattacctgattcactgaaaacgagatgtcctacttatgctttattgagaaggaggcttttcttctgatatttcctagggggtcttaagaaatagttgagagccctctggtagcagtatctgttgtcagtctattcttaagactgaagacaaatgatttcttaaaagagcccgcacctaaatttccagtttcatcaactatgctatttttgaaagctactgggttaagcgttgacatctcttatctattggcagagactggggaccattcagtgacatgaggcagacaaacagtgacccctgcttctgcctccacaggccaatgaagaaatcattctggttgggtcactggcaatgactgacaaactttgagccttcatt

SEQ ID NO: 92967 - DNA, 331 bp, Homo sapiens
aaaaagtctagaaatgtcttcggcaggattaaaatataaaaatatagctatataaaacttaagtgatgagagaaaaaactaaaggagataggagattattttaactttattacctcatctactcatacaggagctttgccagataaacattatattaacatttcatcactcctgaatcaacagtcatcactttgtcatataacaggttcccacttgttttctgatttagattttagattcaaatgtttatcttaaggctaatgtaccctagtaggatgtaacatcagtaacattcagaacatttttgaaaaaataaagacatatctgattc

SEQ ID NO: 92968 - DNA, 509 bp, Homo sapiens
gagtgaatgaaatctagtgaataagtagagaggtggaagggttggtcttagaaataacttggcagatttggtgttgggaagatgaggtagttctcttctggttgcttccatcttttcagtagaataagaggtaaggggaagggtttgtggatgtttttaagagagcagaaggtgtcagacatgagggagtgaaagaataaactgattaaggaaatgtagagtagttactggggagtgctgaaggctccatgtgagacaagttaaaatgggtatgtaggtttctccagttacattctgctgctcagatgtagccatggcctaagtggagaattgaatttaactagatgagtatgacggaggaacagaaaggcaaaggggccatggcgtatttaaaggaatgatgactgtgatgtttctcgaatctaagctaggcaagatggaagataagaacgtgtggtggttcaagagcaatcaattctactaactgattatggggccaatggatgaag

SEQ ID NO: 92969 - DNA, 182 bp, Homo sapiens
ttcaacagtatgctgtaataaaagttatgcaaatgtggtctctctctttctcgaaatatcttattgtactttactcacctattttcagcccacagttgactgtgtaaagtgaaactagggataagaggggactactgtacatatatatagatatgcatacaatatgcaaacatattcattat

SEQ ID NO: 92970 - DNA, 480 bp, Homo sapiens
aaataaaaatcacagagattgtgatttccttatggttttgtgggtaatggtggagtttaaacttacaacgaagtttctggtgacatgtttcctagttttcacagaaaacattctttttttttttgagacagaaagtctcactgtgtcgcccaggctggagtgcagtggtgtgatgtgtcggctcactgcaacctctgcctcctggattcaagtgattctcatgcgtcagcctccaagtagctgggattacaggcgcccaccaccacgcccagctaatttttgtatttttagtatagatggagtttcaccatgttgaccaggctggtcttgaactcctggcctcaagtgacccacctgtctcagcctcccaaagtgctgggattacaggcataagccaccacacccagccaaaaacattctttataatgatacaagtaatataccagacaagaaattactcagtgtactatgtgagattaa

SEQ ID NO: 92971 - DNA, 360 bp, Homo sapiens
aaggacaggctaccgtaagggcagcctcagagggataagctgggaaggcgcaggatgatgtatccttactgtgaaattgaatgggttagggagttcctcccagcccttaggaagagcatccccaagcctgcccgccctttcttgggttcagcgtgtaataatgaaattaaaggatggcagagccctcctctcttctaatcttcttcgtattaagccccaggattaattagcgtgtcagcccaggtcatttatatccaagagccctgccccatttgattctcagcccatggactggggtgttgtgcctgcgccaaacgtgactgccagagctgtgccagtttgggcggaggatgggaggac

SEQ ID NO: 92972 - DNA, 819 bp, Homo sapiens
  misc_feature (21)..(22): n is a, c, g, or t
  misc_feature (800)..(800): n is a, c, g, or t
ggtgactctagcaggatccgnngacggtaccaacacatgaactgtctaatcacagaataggagcattactatgggtattttctccttttcttttagcttatctaaattttgtacttctttgacagactcatattactagtgtaatttttaagaggatagaagaaaaattccctactatttcataagactttgaaggatgttaatgtcttagtttagggaaccaatatatctgaggccatgattcctcaaactacaaacactacattagcaagagacatttccaaaggagtcaagaatttttctagttgccccccagactcacacacagtaccctgctgacttattcatctgtatgtttccagaacctcgcacaatacctgataagtaaacataaatgcttagagaatgaacaactacttatatttacatagcactctatcttgtatatagggagttcatgtataacatctcatttgatcccccaataaccttgtgaagtgggcataaacatttccatttagaagcaaaaaacttgacactggagaattagatcttagggttactaaactaacaaatctcagaaaagagaatgcataacgttgtcaagtaataagttttatgctacaccacaaagatattaaaatgcatgccaagtgttcattcaacactaaacatttattgaagagccactaaatgccaggtacctgtctgtgtatggggaaatgcagcagtgaacaagtgccactaaatcccttccctgccctcatgaagcttatattcctgttggtaccgtcgacggngatcctctaatcacccagc

SEQ ID NO: 92973 - DNA, 873 bp, Homo sapiens
aagcgctgggattacagatgtgagccactgcacccagccctcttgatttttctgattagcagtttcaggtggtgatggctacctaactagtatagcattatagaatttatcatttctgagtaccttttttattcttagactttcatgtgtagcaattttatgtttaacttttcattgactatgtttgtaaaagtaaaatttctctaatttgttagaatttacttgtggggaaggagaggttggagtggaacatagtataacccatatataagatacacgtggcaaatatctttttttctaattctttttagtttatctattagttaatgatagcatgtatttcagaatagaggctaagaaccatatagattttaaagatagcaaaatttctggcaagaaacattatatctttttttcatgggtttagcacttagttttagaagaatttgtgattgtttagtctgtgattctgattcagagggaaacctgtctaaaccctgagcaaagaaagaactgtatttgagcatagttctttacatgttttattctgtagccaaagtatatcaggatatcttagccatgatattcatcaatagaattaactcctatgttgtgttagtggtataccagatttgtatgtatatagttgtagaatacattatttgatctctaaaacatagttctgaatgcctttgattcacagaaagaagtctgtgatgaaataaacttgttttgatttttctgtactctaaatcttttaagtaagtcttctatatttgctgttttattttaatgcaaataaagctttcctttgacagtgaccttggctcagtttagggattgattctgaatataggagacggtaaaaaaaaa

SEQ ID NO: 92974 - DNA, 564 bp, Homo sapiens
aactatgttttagagatcaaataatgtattctacaactatatacatggaaacctgtctaaaccctgagcaaagaaagaactgtatttgagcatagttctttacatgttttattctgtagccaaagtatatcaggataacaacaagtttagtttcagtcacagcacttactttctggtgatatcaaaaggctattcagaaactatgattttcagagatcaatataagtgtattctacagagctatatagcataccaaatctggatataccacgtaagcacagacatagcgagttaattctagttgatgaatatcatggctaacgatatcctgatatactttggctacagaataaaacatgtaaagaactatgctcaaatacacgttctttctttgctcagggtttagacagggtggtgtcgtctctaagtagtacaacgcatccagatgatgctgtccactacggtctgtactgactcgcaatgccttcaggcggcgcttcgtgtatgggcagacgggcctccctaaggttgaggaccgtcttgcggttggctcattgcttacgg

SEQ ID NO: 92975 - DNA, 227 bp, Homo sapiens
taaaggtgtatgccaacttagtggtagaaaaaaggaaggccaatatgggacaccgaagctaataagacatgagtaggattaaattttcagtctagtaacacatgaggaatgcctgtggcaaagcaagaccaagataaatgacataagaagacaaataaaattgcaacttcactgggaatgagatatggtagttgaatttgaagattctgccactatgtttcacaaaa

SEQ ID NO: 92976 - DNA, 418 bp, Homo sapiens
tgggctccacccactttcatgagtttcatcaaatactggatctactcaagggtggagagaaaaggcaactttcaaaaaggagtatgttattaaatgaggcatttactatactccttcctaagagcaccagatggggaacatgttttctaaactagatctaggaagtggaatgtggaatcaatccgtcctcctccccttaagggctaaccactggttaatgaattaaaaaaacaagactaaaaaacaaaccccacacacactcccccccaaaaaaaagaggagggaaaaaaaacaaaacaaaacactaagatgtcccagattactctccagagtggaaccagggagcagcttcaacaattccaattagtctgttacagagtcatccacaagcatgccttgcttttaaacaaaacaaaca

SEQ ID NO: 92977 - DNA, 188 bp, Homo sapiens
tttgttatggcagttagtagtactctattttatgttccattaaaaattgatacatgaatattttctccaaggttctatattgcctactttacagctatagttgaatatctcaaaggtgtctcaaatggcatgtccaagcctgaatttgtgatttcaccagcttcaggttaatcctgtgctctttatct

SEQ ID NO: 92978 - DNA, 470 bp, Homo sapiens
cgatctgcccgcctctgcctcccaaagtgttgggattacaggcgtgaaccacctcgcccagccaagaaagctttcaaactttcaagaaacacaatccccatgctacagaaagagatccagagcatgggaaaaaatacagaaaatgatcccactagattttaggaaggcagcatgactatgactggaaaaccctgaccacggggcgtggaagaggaataataaaacaggggatcctttcccttggggtacgaacatcatgaagacaggaggctctggagagtgagtcccagcttgaccatttcatagtgataccactttgaccaagtgactttcctctgtgatacccccgattgtgagggttcaaggaaataacccccatataaagcacttagtatcaggtgagcaacaaaatattgactggctttagggggaggactgtccatgttcccttaaaatatgtgaaaatctgc

SEQ ID NO: 92979 - DNA, 449 bp, Homo sapiens
ggacccaagcaaagaccctttcattccatccacccagtgagcatggcagcctcctatactttaggaattacatgaatgtttgaagatagcagcccccaccagccgtctttcccttccctccaaatcaagggagtttcagttatgttggaaatctctggacaactcagtggtggagatgcaaaccttcctaacattaggaaggaaaatacctgccagcctagaagagagaacataatacggcttgaaatgaagcttttaagtctgacaatttatgtacagccctaaatctcccctgaccacttgttcaactcatgatgtggtgtttaatttaagttgagtcacagctgaatacacaacgtgaaagcagcccggagccccgctggaaagaaagccctcccgtgtgcctgggcgacttcctaggcagtttgtgaatgtggagctccctgcat

SEQ ID NO: 92980 - DNA, 459 bp, Homo sapiens
tgtgcctgtgattctgtgtcaccttatccctgaagactcttgtaatcattaccacaatcaaaatacaaactatttcaacaccacgaagatctctctcatacagtccctttatggtcgtccctttctttcccccacaccatccctaaccctttgcaaccatcagtctgttctccatttctataattttgtcgtttggggaatgttttataaattggtcctcacagcttgtgaccttctaagattagctcaccatcccccccacccccccaccccacccaactcagcagaatgccctagagatttatccaagttattgcaggtatttctagtttgttcctttctgttactgagttctacactatgggtgtaacacagtttgtttaatcattcagcattcacctatcatacattttggttccttctttttttgggcggggggagtgcctattacaaataaaa

SEQ ID NO: 92981 - DNA, 1121 bp, Homo sapiens
ctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctca

SEQ ID NO: 92982 - DNA, 413 bp, Homo sapiens
ttttttttttgagacggagtctcactctgtcacccaggctggagtgcggtggcacgatctcagctcactgcaacctctgccttccgggttcaagcgattctcctgcatcagcctcctgaatattttttctttattcagtttgactttccatgatttctaaaccatttagtggagacacacaccaaccaacactgtacgtttcacatgcattccttgaagcagaaagcaccctatactgataggcttcccttaccctaggtttctcccctccacacaattctctttctttgctttttttttttttttgttgggaaaatttattcattaattttttcactgacgctgacttttttcaaaagattttattttttggccagacatgggggctcatgcctgtaatccccaatactttg

SEQ ID NO: 92983 - DNA, 347 bp, Homo sapiens
ctcttctgttgttagtttactttctgatgcagtttagagccagtctagcttagacagatagcttggtccatcagtcatttcatgcagtctatttctagtatctttaactccatcccttccattctactcgcctgtcagaatccaaatctgggatcattgatgctgtttgctttttttaggttcatattctgaaaactgaatgctgctggaaaagatcccacaactgaaagttcattgtcttcagcctcagtaatgtccagcagttccccaggatacccccctcttcccttctctgtggcaactgtgtcagaatttccccagtcttctagaacctctgttatttactc

SEQ ID NO: 92984 - DNA, 426 bp, Homo sapiens
atttttgtatttttctagagatggggtttcaccatattgatcaggctggtctcaaactcctgacctcttgatcgacccgccttggcctcccaaagtgctgggattacaggcgtgagccaccacgcccaactgaaaaacgtatttttatatgtaaccaaggggaggagagcagaaaagagacactaacctattgctaggtgttagcagagttaaaagaaattgaaagcatagaaatggaatttaggcaacacacagctgtcattgaagaaaagttttccatcatagtatagatatttttcttgggaaagggactcctgaatattgaacccctttaaagaagagaacttgttgcttacttgttttagtaaagagcacagaactaaatatttgggtgtttcttgatacaggattggctaccagacaaga

SEQ ID NO: 92985 - DNA, 553 bp, Homo sapiens
tggatttacaggcatgagccactgtgtccagctgaaaaatgagtaggaattttctaaatggcaaggagaggcaaagcatgttaatcaaagggagtgtcatatgcaaaggcagaggcataacaaaaatagtgcaaataaatgcctacacatatacaaaaggagagttattgtgggacccatacataattttgttgatttcttgatatgctcatatccattttgtgttgcagtgattctaagatctgtattagtatgtagactttgtgaacaggtaaacatgtttaagaattttttaagacatggctgtattagatatcgaaattcctctcttcattttcatatctttactttggaattcatatatgccttttgatgttatcatctgacttgtttctaatgaaatttagccgcttaggcaggacgtggattttaggtttctgcttagtgttttggcatctggatttgggattacttagcatttttaatttactaaaataaccaccaacttacactcagttgaaatatgaacatgtcggtttcacttgagcttggg

SEQ ID NO: 92986 - DNA, 814 bp, Homo sapiens
gacattatgagtatttgggttacagggacaataacttgtttttctctgcagtcctgtatatactaatatgaacaggagacaggaaaatactgattagaagagggcagttccccagcaaaggtggaatgatgtggtagagaaagagaggagggatgtctggacactgggccggcgacagtcaggagcagagaccggcagctacgtggcccaactccaggggaagaccaccttcccactccatccccctcttcctgctccccatccatctcgctgagagcccacctccaccactcaataaaaaagaaaaagaaaacaaaaaaaaaaaaaaaaaaaaaaaaaaaaaaaaaaaaaaaaaaaagagagggggggggggaaaaaaaagttctcccgggggggggcaaaggtgtaggggagcaccaagttttgtgtgagaacaagaggggggccccaaaggacgagggcgcataataaaacgaaaggagaaggggacgcagagatataaacaaaagcgagagagagaggagaaaacacgagcagaaaggaggaccaactggggaggaaacagacaacaacaagaagggaggggagagaagcacaaggggacaggaaaaacaaatccccgcacggcaggaattaaaacaacgagcagcgaaaggggagagataaacacaaaaccaagccaagccggcgcgagagatacggcggggggagaacaaaaggagggcagcaaaaaacgcacggggagatgcagcagaagaaatagtcgggccgacagagaggaaaaagacgatgaaaaaacaaaaaattataaccc

SEQ ID NO: 92987 - DNA, 1563 bp, Homo sapiens
cttggaccttggccctcgctttccaggatgggtagggtggaagacgggggaacaactgaggagctggaggactgggacccaggcaccagtgccctgccagctcctgggatcaagcagggtcccagggaacagacaggcacggggcccctgtcccaaaagtgctgggagcctgagcctgatgctcccagccagcctggcccagccctttggtccaggggtcgggcccgcactcaggccttggctggcggctcctcactgcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatgaactgggctgggatgagatgtccctacaagttgctgaggatggtgctggccttggtgtgcatgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagcacca

SEQ ID NO: 92988 - DNA, 1249 bp, Homo sapiens
ggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatgaactgggctgggatgagatgtccctacaagttgctgaggatggtgctggccttggtgtgcatgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagcacca

SEQ ID NO: 92989 - DNA, 1634 bp, Homo sapiens
ggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatggtaacgggcctgcccggtggggggcgtggggaggggccccaggtgagcctcaccacttctcgtctgcacacacccatagaactgggctgggatgagatgtccctacaagttgctgaggatggtgctggccttggtgtgcagtgagtaggggccggggggagggccggggggcctctcagcctgcagccagggcacctcccacctgccgcgtccctctgcagtgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagcacca

SEQ ID NO: 92990 - DNA, 1474 bp, Homo sapiens
ggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatgaactgggctgggatgagatgtccctacaagttgctgaggatggtgctggccttggtgtgcatgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagcacca

SEQ ID NO: 92991 - DNA, 378 bp, Homo sapiens
ggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcaggtgcgtcggggggtggtctggggagctggcaccgcccccaatgcggccctcctgccgctgagctgagcttgtgcgggaccgagctccccgaaagccccgctcggtacctacctcatccctccacgaccttggtccgtgtgtctgggaccccaggagaggactgactggaccagagctcctggctggagaagggagagtcgggggga

SEQ ID NO: 92992 - DNA, 634 bp, Homo sapiens
gagattaaaataaacaacacaaaatgtatttaaatgagaaattgaaacattaaaaataatattaggtgacattaaaactgtcatagaaataaactgtatatacaacaaataaatcaatgattgttaacttttttagacagtttgaatatcagattataatgaatagcattattagccagtaaaaagagcatataaattattttaaaattccaaataaaaatatttaaaattttgaaattttggacccaaaattatgtcagtaatttcatgaaagtagatctccaatagggtcctatattctagacactatgaaatgacatcagaaaccgtcaattaaagtgtaccccacaagtgataactagctacatacaagtttaattttcgatcaatttgaataactgttgaatttaaaagaaaattgatgctgaggttaatttacagagtcaatgaaatgccaagaagaaagcattgagactgaaaccaaagaaccaaatatcgcataacaaattctatcaacactaacttacatttgtagagagaaaaatctattctggccatatgtagctactaatattttcacatatgattaataaactaatcacattctgcacatcagtgtatcatactgtatatt

SEQ ID NO: 92993 - DNA, 204 bp, Homo sapiens
actcctgagatcttattggaaagctgctgatcaccagtttcaggcgtttctatctattgggagactgccgttgcatggtgccagctgtgaccaattattagcgatacagtgtgacaatagcttgcccatcaccctagggtcgcctgctgttcctggtggggtagggggagccttctcctgtcctgctcatgcctgactagctgc

SEQ ID NO: 92994 - DNA, 367 bp, Homo sapiens
gtgagggccaggggcccttgtgggccagcccctttgccgctatcctttggggggctccacaagtgactcttttatacctccttccacccccatccccaggggggtcagctggacagccccgccccttgctataatagacctgtgtccttggtgagttatttagcactctatgccttagtttccccatctataaaatgggagccccgacagagcctgtctcactgggcatctgtggagagtaaaagaatcactctatgggccgggcgcggttgctcattcctataatcccagcactttgggaggccgaggcgggcggatcatgaggtcaggagttggagaccagcctggccaatatggtgaaaccccg

SEQ ID NO: 92995 - DNA, 830 bp, Homo sapiens
gaacctagcttaggaattgttttacatactagagcttttgtttggttttagatttttttctttttggggagggggtggggtggggaggggaggcaggtagcaaagtactcttcaccacaaagaagttgaaattgaaaaggaaatctgtaggcacttaaatgaaaagcagggcattttgctgatgaggtcaaatgatactgatcaatgggaagctctgggagaggtggctgtgtaaaggagagactgggtgacccagggaagtgtccggagctgaatgagaagttggaatcacatattcctatgttgcagccttcaacctgatactaactcattcttcagacacggagtccaacttccaagtgcttcagggatttttgttaagccttttaagggtatccaaatgaattaactattgtgtttcaccaacgctctagtaattcactttcagtgggcggttttattttcccagatgtgcagattgttcaccatggagctatgagtaattaactcataaaagaaatgtccagatgaatgaacaactgcaaagcacctgttgtcaacagctgatttttgtctccgcgctttgattatgaagagcttgagaatactggaggttgttttcttcttctaaaaccttgtgacacctgctgatttaggttcacatagaatacaatggtaaatagagaataggtggtagagcttgtctttatatctaatgaaagaaaagtgtcaaagtttcagatgaatgtcagatacccaaggatagggctgcattatgactttcatgggccttaggcacttttgcctttgtgggtccgtttctccattaa

SEQ ID NO: 92996 - DNA, 805 bp, Homo sapiens
ctctgcctgctaaggcccagactatgtgcccccaggctcaccggccatggagcacccccactggggccacaggatgagcccaaactcaaaacaatcccccccacccaggtcgtccctgcaggcttagggttcccaacacacctggctcccccctctcctctgtgtgcacaaacacatgcatgtatgcactcacacactgttccctcgcctagaaccctcccacttatgccccttgtcagtccttccaaacccaacgtcaagtgttccctcctgcacgaatccctccctaaccccccaaccttcggtgcctccccagtggcttagtgtccccagcagtgtcttgtgccctggagtgagagtcacccttgggctcggggcagccaggccagggctctgggggacgcataagccgcctccagaggacatcagccatgcagcgtgctgagagatggcatcaatggtccaggagctcattagagatgagccattatctggccagacgctgacacagcggggacccccacaggcctcctgcttcgtgttgtgcaatcagggactcctgtccccctcggcgcccacagtggggtcgctgctggttgccaggcctggggttggagcctgggcttggatctttgcttacgtctgccctgcctcctgcagctcccagacaggcagaccagtgtgaggtccaggggtggaaggcagtgggcagggcagagggtccccacggggtccacaggtgtcctccagccctcacctcgatccagccctgcctgaggttcttgtgatggtttggctggggagg

SEQ ID NO: 92997 - DNA, 256 bp, Homo sapiens
ctctcttgcttcttgcaagccagcctcctgggtccaaacaggggctgccctagatttaggaataaggtcactgagcagccaatggccaaggaacaaaatttgggcaccagccttggatgctaaggcaagagccgccacacctaccaccacagcacccacagaatctgctgagactgacgctggcgtcccaaccagacacttggaggcatagggcatgcccttcaagtctagaaccctgccaggtacctatccctcc

SEQ ID NO: 92998 - DNA, 591 bp, Homo sapiens
agtccccagtgcccttcctgatagtgacctatttgaagagtccaggcaagttgttttgtaggacattccttaacttggatttgtctgattgtctcattggtggtttcaggttaaacatttttgtcaggaattttttataggtgatatggtgtcctcgttatgtcaggtggcacttgataccagtttgtcccattattggtgatttgaagttgtgtctgccggatttctcccttgtcaagttgataccctttcccctttgcagttaataagtagcctgaggggcgatatttgagactaggaatatcgtgtcctcagcagtttgcactctgttcattggtcattcttgactgaattattactaaggtagttgtaaactgattttttctgttgtcattccttctacatttttgatatttcttctgtgaagatgagcctttaaagaaatttgatggaatttcctgatttgatgtatagtaagcatttctgccattattgattttgatgctgaaatgtggcttctgtgttctttgagcatctcctatcagtctttgatcacctccctaccttgtgacagacaagatggcttccatg

SEQ ID NO: 92999 - DNA, 422 bp, Homo sapiens
ttaaagcaagtaagctcaattcctgagttactgttggaagctttccgaaagataaggcttcagtgagagagctggactttggatcagacagacccatcagtctgccttgctctggcctccctagccatgcaggttcttgagcaagctagtgagctcagtttcctttgggtgagctagggacagcaaccccttcagagggtttttctgcagatgaggtcggggaaagggaatgagcatgggctacataggagaacagaggagcccaagacaccttagttttattctccttgctcttgggacttccatttctggaagataatttttccacacctcccaagaatttctttgattcaacatctaaaaaggctgggtttgacactacaaaatttggtaagcagtgattccataaagcaaaccaacaa

SEQ ID NO: 93000 - DNA, 392 bp, Homo sapiens
tccagccaacagcagcaatccgtgacccgtccacttctccacaattgtcccagcaaatgcccttcatagcatagagcagcctcaggaccctgggctgcctgtggctgtgtccccctctgtcaacctggggctgctcctcagcctttctttgatgttcatgaccttgactctttggaaggttacagcctcctttggttacagaatgctcccccatcagcagcgtcaggtcatgcacctgtaggggtctagctccgcctccacgctgcatccttcttgcctcctagcaggtggtccagggcttggctgtgccccattgctggtgatgttctgtttagttacttggtgaaggtggagtctgcttgatttcactgtaaagttacttggtttccgtt

SEQ ID NO: 93001 - DNA, 754 bp, Homo sapiens
atccaatgaaaaccacaaaataaataaaacataattttattaacagattgggcctatgcctagccagggacttgaacaatgttacatgtttatatttgatacatatactctttgttctccattataatttctctctgctataactaacacttttattcctagttataaaaatagaagtcaaaagacttctatttttgccattttatgttaattatttatcatgttctaaccaggtaaaggtggttctatcatgatcaattgtaaataactttgctgagatagtgtaattaaacataagaaaaatttcacattagacatatcaaatagatatctaatgagagaagaaaggtgatcagtcatcttctgagctaatcattttgtgaacgtattttaaattgcatttttaaattaacaagctgacaccataagaaactagaggacctgtttaattgctgaaataattattttggcacatagttgctaagcattgcacatgaacagcaaaaatggtagaagctttagtagctctttctgtcatttctggctgttcctagttcatcctctccccaacccctttgctgtctgtagagagacagcaggtgccatgcttctgctctgactctcgttctagagtcacttcttaccttatgtacacaggaagaaaatatacgtgaatggagagaataattaggacagtgaggtacactggagaggatttaaaagtcacatggagaaaggaagaaaagcaatgaaa

SEQ ID NO: 93002 - DNA, 782 bp, Homo sapiens
atccaatgaaaaccacaaaataaataaaacataattttattaacagattgggcctatgcctagccagggacttgaacaatgttacatgtttatatttgatacatatactctttgttctccattataatttctctctgctataactaacacttttattcctagttataaaaatagaagtcaaaagacttctatttttgccattttatgttaattatttatcatgttctaaccaggtaaaggtggttctatcatgatcaattgtaaataactttgctgagatagtgtaattaaacataagaaaaatttcacattagacatatcaaatagatatctaatgagagaagaaaggtgatcagtcatcttctgagctaatcattttgtgaacgtattttaaattgcatttttaaattaacaagctgacaccataagaaactagaggacctgtttaattgctgaaataattattttggcacatagttgctaagcattgcacatgaacagcaaaaatggtagaagctttagtagctctttctgtcatttctggctgttcctagttcatcctctccccaacccctttgctgtctgtagagagacagcaggtgccatgcttctgctctgactctggaaccagactgcccgagttgaaatcccagctctgctatttaccagcttgagcacctataccactgctctgtgcctcagttcccccatctgtaaaatgagtactgtaattgtaataacttcatagggttgtcacatgcatttaaggaaagtacctggaa

SEQ ID NO: 93003 - DNA, 353 bp, Homo sapiens
agtgcctctctgttcttgagctctgttgctgagaggtacatcaccaagatgcattagcctaatagaaaacttcactaagtccctctgaatggagtccaaagagaatcttacttaaaatgaattctacctgacagcacctgcactacatggacgttaaggacacatacaacaaaattagctagaactgtaggacctgagttcagtcactctacctctcaggatctcagtctccctatttatagaaatgaagtgacttttagataaaagtaatccctaagaaagcagccaccaaaacccagagaaaccaataaactttattagaataaagaagtattatagtttgtaaaacaaca

SEQ ID NO: 93004 - DNA, 256 bp, Homo sapiens
tggacactcaaacaccactggtataaacagaaattggtaaaaaatttttggagggcaagtctgtactacttagcaaatgcatatgccctacggctcagcaatttcaattctagaaatctatcttacagaactacactgtccaatatccaatatagtagccactggccacatgtcatccacccgcctcggcctcccaaagtgctgggattacaggcgtgagccaccgcgcccggccaagccactaaaattttctttc

SEQ ID NO: 93005 - DNA, 937 bp, Homo sapiens
gctcctctcagacacctagctgtagtttgaagtaaataattcaaacaggcctggaccagtgggtcacacctgtaaccccaacactttgggaggctgaggtgggaggatcacttgagcccaggagttccagaccagcttggacaacaaggcaagacccttgtctctacaaaaaatttaaaaattagccgggtgtggcggtgcgcctgcaggtgggcgaatccattgagcccaggaggtcgaggctacagtgagttctgttcgtgccactgtactccagcctagacgacacagagagactctgtctctaaataaataaataaataaatccatctccaggatcctattagacagcacaaaagaactttgatatgcctatttcaaattataaaacatacacgccacaaattttcttcctcttatttagtagtcagtggtatcattaccgtaggaacgccgattttaaagactctattaagcataaattatgttaagacagaatctataacaaattctacgaattcaagagacagttaacctggtcatttccaagcctcaaattacagccttgtcagaattctattgcttgctggtacttcaacatcctctagataagtttcatatactgagttcctagtaggactctgacaccaactcacagttcccaccgggcaatgagctcgccctttgttaggggccacggagcagctccgcccagcgcgctgccccggcccgaccccgggttggcgcggtcagtggtgcacgcgcacccgccccaagtcagcaccttccgagagccatagggtcgtcgcgcggctcaccccgcgatttgcgccgtccacgctggcctctaaagagcccccgatgtgctttcttctcgaaaaagctccctttttaaagccttgcacctacagggactcgggggtgcgtcacaagacaa

SEQ ID NO: 93006 - DNA, 225 bp, Homo sapiens
gccaactgaaaagcagctcataactttgttacataaaagttgaaccagattagtctgatgcaattccaacagtatgtaaagcgtattcaatgtccttgcaacccctaaaagctccaaaaccctaggaaatcaatacccgttaggttactgagatctgtggttacaataggttgagctgtctgaatcatctaaagccaagatgataccaaaaagtatagacatttt

SEQ ID NO: 93007 - DNA, 151 bp, Homo sapiens
caaaccaaggaatgcccaaggccaccagaagccagaggacacgagtgacaacacctccctagagcctctggacagagttcaaccctgctgacaccttcattctggactttcaacctccagagctgacagtgagagaataaatatctgttgc

SEQ ID NO: 93008 - DNA, 241 bp, Homo sapiens
aacccccagccaagccccccgtattcttacaggggcccttttttttgcgaattttaaccaaaatttttattttcccaattagccccaaaaaaaaaaaaaaaaaaaaaaagctaccaccaacgaaactcactgtgataaccattacaatgggaaatgataagggctggcaggcagtgaaaacagtaagcttttcactgaacacagcaaaactcaccacttaatagttttctattttattgaa

SEQ ID NO: 93009 - DNA, 874 bp, Homo sapiens
tactgcttccaaggcagagctcaggcaataatgctcactggctggcagctcacctcctgctgtgcacctggttcctctcaggttcctaacaggccatggaccagtaccggtccatggcctggggattgaggagccctgcgaggaccgccttgtccttttgccttctgtgtgtgggaggttcatttctttcagtaatttctcaggatggacataatgtgtcaagaatctgtcttcactaggcagggcatggtggcttatgcctgtgattccagcactttgggaggccaaggcaggcggatcacctgagattaggaattcgagaccagcctggccaacatggtgaaaccccatctctataaaagtaccaaaaaaaaaaaaaagtcaggcatggtggtaggcgcctataatcccagctgctcaggagcctgagtaagagaatcgattgaacctgggaggcagaggctgcagtgagccgagatcgcaccactgcactccaggctgggcatcagcaagactctgtcacaaaaaaatagaatctgttttcagaggtagcatcattaggaaaaataaaaatacaatactgattcaggacattttatgtcactaaactgctctcctccatgatagtgccacctcctctttaccctcagcaagccaccagtatctcaggtaccttctttctgctatttctactatatttttgatttgccaatttagccaaaaaaaaaaaaaaaaaaaaaaagctaccaccaacgaaactcactgtgataaccattacaatgggaaatgataagggctggcaggcagtgaaaacagtaagcttttcactgaacacagcaaaactcaccacttaatagttttctattttattgaa

SEQ ID NO: 93010 - DNA, 316 bp, Homo sapiens
acagagccgttccaccgaggcctgatggaacaggaagcgggtgtctgcggcaccatcccagaaccagctctgcagggggaccagctggagggggctctgtgttttcctccctgctctaaacagaaagccgtttttctagatgggaatctggatctgttaaaatataatcggtaacgagaccaggattatttatttaagtatgtggaacgctgagggagtgttgtacttcccagctgggctaggagctgcaaacgtccaccatgtcgaggggcacggaaataagaactcgccaccccttcggagatgcctgcatagt

SEQ ID NO: 93011 - DNA, 101 bp, Homo sapiens
ctagtacctttctattctaagcgcaatatagtgtcagtagtgataaaatgcatggactgagtgccagggaagacctggactctgatcctggtcacagcaaa

SEQ ID NO: 93012 - DNA, 354 bp, Homo sapiens
gctggtagaattcttgggccaaagtcactttcttcagaactgcaagtggccttaggtttcctgctgcctgtggttgctgagaccccagggccgttctgcctgcagcccctttcagggtccgtttccctgggacctggagggcttcaccctcagcccccttgggcctgactgcatgcccttcagctggggagtgttctagaatgtttcctgtggtttccctccctcagcctcgtctctcctcccctctcccttgcctgtggagtatagactggctgccagtgtaggggagctgagcggggtccaaggtctggggcctcttgggattcagccccattgtcaccccagcctgccctc

SEQ ID NO: 93013 - DNA, 383 bp, Homo sapiens
aggaatccctgttcttagtgcagtgatatgtatattttaaaattgaaaacagaaagccaaatcctagctgtgggaaaggaaccctgagtctgtgggctatgcggcttctcagaccttgagacttgggtaatatgtcactgcatcttccgaacactgcatattgtctcactgtgtattcagtgtggtttgcccctcatttctcactgttgcctccctacatatggagtgtaccccagtttttgcttacactagcagaagagcactatgtcttttggaaactatagacgtaaatccttagtgatgaaaccaagacaggaaaaaagaattctagcttcagtttttttaagtttaataatttattgtgttaagttaggacaacacag

SEQ ID NO: 93014 - DNA, 349 bp, Homo sapiens
gccctaggtgattctctggcagggaagtcaccaggaaccctccagaaggaagaaatgtctagcatgtcctaggtccccgcacccttgcaaagacccagagatgaagcaatgctggatagaccccacctgcacacagagaagaaaggctgctggagagacatcatcagaggagagagacagtggctctaatccaagaatccaggcaacgtgtgtagggctcagggtggcatgtgtgtgttttcatgcccagcaccaggacctgagcactgagagctttccctacctgccatgggatcctggtatcaaggtgttgcccgaaggtttcagcaccatgtggtcaattgtccat

SEQ ID NO: 93015 - DNA, 436 bp, Homo sapiens
tggcaattccactcctgggaatctctcccatggaaacaaaattatcagcatagaaagcgtaagtacaaggatgtctatgacagcaccgtttgtagtagcacaaaactggaaacagagcgaaaggtcatctgcaagagaatagtgagttacattttgataatctgcaccaaagaatatgatgcgatcatttaaaggaaggaaatagagctctatagccacatgccttggaggtatgcctgtgaagtgttgctcagtgagaaacacagatgtagaaaagcgtagagatgaccaaaccctctgtgtgtgcctgcgtttgcgtatctatgtctatatatgtttagctctgattaggaatatatgtataggtagaaaaatatggattaatatattccaggttactaacattggttcttggggcttacagggtgagcctagc

SEQ ID NO: 93016 - DNA, 247 bp, Homo sapiens
aacaaaagtgaatgataaatagacctagggtgatatgtgcttaaaatactatgcattattttagtttttcattgataatttgaattgtgtgcttgccttgatcttgaaatttaggatcactgataaaatttacctatgcatttcagatagttttttatttgcatataaatatgaaagtacaaaaatatgaaggtgaacactgcttgtgtgtgtgcactaatacttatgtaaaataaattcagaaaac

SEQ ID NO: 93017 - DNA, 171 bp, Homo sapiens
  misc_feature (3)..(7): n is a, c, g, or t
  misc_feature (52)..(52): n is a, c, g, or t
  misc_feature (171)..(171): n is a, c, g, or t
aannnnngaatttaatccatttacattcaaggttattatttataggtgaagncttactcctgttattttgttaattgttttattgtagttttgtatgttctttgttcttttcctctcttattgtttagtattgtggtttgatgattttctgtagtataaagtttgattatn

SEQ ID NO: 93018 - DNA, 751 bp, Homo sapiens
ctttgaagaggaggtcatgagtcctcacttacaggcatgggctctacttctgtgcgaacagggccagggcccccaggaagcctcccagagcctcttccttcctcccaacttagggtgttcaggccccacagactctccagggagtggctgccatgtcctctctggagcaaccatgaagttccctgctgccctcatggcttcagggatgctcgttcacgtcactgggaggggatccttgtgggtcgtgacctcacctgctgcctctgatgaacttcggggcactttttcctccctttgccaaatgacctcactctcaccaacactctgaggattgaaagttgtctgcactgcatgatttttgcttttgagcaagtcaaagctcacaggagtctcacacatgcatagcctgtattaatattacacacaattcctattttcacttttcctatcttcttccaattttctctgcacacttacttactctgcccatccactttctcctgtgaagctgctaatgtgggtttttatttccaggctgatgtgatttccttgctgcaatactagacatgtgctcatcacatgcccacatttttaagaataaagtattttgagcacaatttgctcttcttgtacttgtatgtcagggtggcagctcaggggatcggtttgaaaatttatttgctaaaatgcatgaatatttctagaaattcggtgttataaattaaatgtcttcttgcatcccacaaatttt

SEQ ID NO: 93019 - DNA, 298 bp, Homo sapiens
ccaatttttcattgggcagcattaatcagaggcttaataagagagaaaggagcaagttgaagaatctaagaaggaaacaacgaaggcgtgaaagatggctacagaagcagggtaaatactcaggagtgggattgctggatcatatgactttgaataatgagatgagtacagatgaagacaatgaatatgcagaagaaaaggatagctacatctgtgcagtgtgtctggacgtttatttcaacccttatatgtgttacccttgccatcacatcttctgtgagccctgcttacggactct

SEQ ID NO: 93020 - DNA, 548 bp, Homo sapiens
agttttgaaattgggaaatttgagtcctccaactttgttctttttcaagactgtttttggctgagattcattgcatttgcatttgaactttaggataaacttgtccatttctgtgaaaaatggcagtaggaattttgatagggattgcactgaatctgtagatcattttgatgggtattgccatcttaacaatactgttttccagtcctatgaacatgggacgctttcccatttatttaggctttctttaatctctttcaacaatgttgtgtacttttcagcacacaagtcttgcacctcctttgttcaatttattcctaagtgttttattgattttgaagctattgcacatagaatggctttcttaattttatttttgaattgttattgcaagtgtatagaacagagttctttattatccccatctggcactagcaagccacactgggggcacaaactgtcaccaccacagccacctctaaggttgacagtgggagactgtaggcactaagtgaaaagttgcaacattctcctaaccaaaatttaac

SEQ ID NO: 93021 - DNA, 357 bp, Homo sapiens
tgtgaatgagtgggttagtgcatgaatgagtcgggttattgtgtgaatgagtttgtgaatgggttagtgcgtgaatgagtgggtgggttagtgtgaatgagtgggtgtgtgaacgagtgggtgagttagcgtgtgaatgaatgggttagtgtgtgagggggttagtgtgtgaatgggtgtgtgaatgagtgggttagtgtgtgaacgagtgggctagtgtgtgaacgagtgggtgagtttgtgaatcagtgggcgagttagtgtgtgaatgggtgaattcgtgtgtgaatgtgtgtgaacgagtgggtgacttagtgtgtaaatgactgggtgtgagcgagtgggtgttagggtgtg

SEQ ID NO: 93022 - DNA, 454 bp, Homo sapiens
ggatgtggactggacttctattgatctctgctatagcaagaaaaatactgccttacattattattattggcaaattttgcgtttggaattaaggtggaggagaaattcaagccacctgaaagggaaaatagatttcatatcatttaggaaggaacaaatcctggcactgtccttggctgttatataaatataaatttcctttaataagctggaatatcttggcaaaatgcctatgggaaaataaatagctatagattctaataataaatacaattagtgtttttaaggagggtagaggaggtaattaagtctatttcattatgtcggggaaagacttgagaaagatgggccttatggaatacataaggagaggaggaaggagaagtaagtaaactgtgagcaaagccaggctttggggcaaatacatggcttatgagaattcctggggggtgtc

SEQ ID NO: 93023 - DNA, 402 bp, Homo sapiens
cttagcaaactaatgcaggaacagaaaaacaaataccatgtgttcttacttataagtggaagctaaatattgagaacacatggacacatagagggaaacaaaatacactgctgcccacctaccgaagggtggagggtgggaggagggagaacatcaggaagaatagctgatggatgctgggcttaatacctgggtgatgaaataatctgtacagcaaacccccatgacacacatatacctgtgtaacaagcctgcatctgtacccctgaacttaaaagttaataaagaaaagaaaaacagccttgcatttttaaatggaagcagaaaatagtatagactgtatatgaatggtctacattgtttattacttcatttgtggaacatttttgtggttggcataag

SEQ ID NO: 93024 - DNA, 617 bp, Homo sapiens
ctttagaaataaaactgctatagatattcatgtgcaggatttatgtggacatgttttcatttatccaagataaatgctcaaggggctaattgctgattcttaagagctggaggccgaggagtggtgcaagcacctctgcatggagtgtctggggaccaggctcaatgacatcagccttggggagcccgaccttctggccgcaggagtgcagcgggaacagaatgagagattcaacgtgtatcttatgcctacgccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccgggtaaggccccttccttggtaacctatcagcttggaaatgaatgtcactgggatctgaaaaaaaa

SEQ ID NO: 93025 - DNA, 1575 bp, Homo sapiens
ctttagaaataaaactgctatagatattcatgtgcaggatttatgtggacatgttttcatttatccaagataaatgctcaaggggctaattgctgattcttaagagctggaggccgaggagtggtgcaagcacctctgcatggagtgtctggggaccaggctcaatgacatcagccttggggagcccgaccttctggccgcaggagtgcagcgggaacagaatgagagattcaacgtgtatcttatgcctacgccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggtcatgggtttggttcgtcaaagatgtctcgtgcacagacatttcccagctacgccccagaacagagtgaagaggcccagcagccgttgtcgcggtccagcagctatggattcagctacagctccagcctcatccaatgacacacagagagccgctgttgactagagagacagtctgtcctggacccgtctgtggggtcattaccctctgcctcctggaagaccaattgcagtacaaattgaaatgggtcggctctagccccagtcccattggaaggttaaaaactggagttctgcttccttgattcagtggctaagtcctttatttattgaatttctttgggggaatctatgttttacataaatagaatccaaatcgtatgaacagttatttaaataaacaaaattctttgggtctgacagtaacagaaacctcagcactgggaaaagctgcccacactggggtatgcctgggtgatgggcacctctcactgacctcacagcgcagtccgcccatctgagcacagggtctgtccttagacataatggtgaccctccacaagctctgtggcttttaaagttctgacagggataaatacagtaagctctgcaaatgacatcgtagctgcatataaataaacccagtgacaattaaaggaacatgaaattcagaacacactattaagcagggccctgtagctctactcgtgtgtgtgtgtgcgtgtgtgtgtgtgtgtgtagacaaatggatattgctatatccatctatatataacaagtatatatcaaacatgtgctgagggtgacaggatatgctcacttaaattgttgaaaaccataatttggtgcattaaagttaagattgttatgttgaatagctatttttaaaatagtgctgtaaaaaa

SEQ ID NO: 93026 - DNA, 1234 bp, Homo sapiens
ggccccgttccccgtccgcggcggccctgcaggcgaccccgcgtccccaccggcgggagctcggggaagagcgggcggcggcgctgctgctggcggcggccggctggatgcgagacccgcgcagacccggcggcggacggcggctctcgactccggagagcggatcgcggggcgcaggagcccgatcgcgctggccatggcctccaactttaacgacatagtcaagcagggctacgtgaaaatccgcagcaggaagcttgggattttcagacgatgctggttggttttcaagaaggcttctagcaaaggacccagaaggttagaaaaatttccagatgaaaaggcagcttatttcagaaactttcataaggtaactgaactgcacaatatcaaaaatataaccagactgccccgagagacaaagaagcatgcggtggcaatcatctttcacgatgaaacatcgaagacatttgcctgtgagtcagagctggaggccgaggagtggtgcaagcacctctgcatggagtgtctggggaccaggctcaatgacatcagccttggggagcccgaccttctggccgcaggagtgcagcgggaacagaatgagagattcaacgtgtatcttatgcctacgccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggaaatcatgaaaatcggcactccgatttaacaggaaagagttgcaagaaatccgagaacagatttcttgaagaaaatgcacccttggttatgtatggcatcactcaccatctgttcatggatacttctacatgcaaagttgtacatgacttggaataaaccagctctagttttatcatcagt

SEQ ID NO: 93027 - DNA, 611 bp, Homo sapiens
gaaatcatgaaaatcggcactccgatttaacaggaaagagttgcaagaaatccgagaacaggtaagacaatgggaaggatataaagcagactaaagtgctcatcaaagtaaattgaaaataatgataaatgcttcacacaaataaaacaatttttataagcacttagaaatccaataactgtagctgaaaagagactatagtagcttcagaaaataataggcattaataaagtaacaaagaaagaaattcagtcagagagacggaaaatacatgggtatgcgcacaagtcaaataatggaattgaacatacaggttttcctgaaatagagaataaatacaagatgtatataaagtctttcctgaaataaaggaagacctatggcttaactcaggtcctcctagaagcagatgccgagatgggttgagatgcacgagagttagccagttaggggtcaccagatatttgaggaaagtatgaaacaaaaaacagaggccatagcaaataaaattgcgtcaaaaggaacctcgaagagaccgaggcagtgcagaaagcagaataaaaccatgcacacaagcaggcttacaaacaaggcaataaacacttcactca

SEQ ID NO: 93028 - DNA, 853 bp, Homo sapiens
ctttagaaataaaactgctatagatattcatgtgcaggatttatgtggacatgttttcatttatccaagataaatgctcaaggggctaattgctgattcttaagagctggaggccgaggagtggtgcaagcacctctgcatggagtgtctggggaccaggctcaatgacatcagccttggggagcccgaccttctggccgcaggagtgcagcgggaacagaatgagagattcaacgtgtatcttatgcctacgccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggaaatcatgaaaatcggcactccgatttaacaggaaagagttgcaagaaatccgagaacagatttcttgaagaaaatgcacccttggttatgtatggcatcactcaccatctgttcatggatacttctacatgcaaagttgtacatgacttggaataaaccagctctagttttatcatcagt

SEQ ID NO: 93029 - DNA, 1956 bp, Homo sapiens
ggccccgttccccgtccgcggcggccctgcaggcgaccccgcgtccccaccggcgggagctcggggaagagcgggcggcggcgctgctgctggcggcggccggctggatgcgagacccgcgcagacccggcggcggacggcggctctcgactccggagagcggatcgcggggcgcaggagcccgatcgcgctggccatggcctccaactttaacgacatagtcaagcagggctacgtgaaaatccgcagcaggaagcttgggattttcagacgatgctggttggttttcaagaaggcttctagcaaaggacccagaaggttagaaaaatttccagatgaaaaggcagcttatttcagaaactttcataaggtaactgaactgcacaatatcaaaaatataaccagactgccccgagagacaaagaagcatgcggtggcaatcatctttcacgatgaaacatcgaagacatttgcctgtgagtcagagctggaggccgaggagtggtgcaagcacctctgcatggagtgtctggggaccaggctcaatgacatcagccttggggagcccgaccttctggccgcaggagtgcagcgggaacagaatgagagattcaacgtgtatcttatgcctacgccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggtcatgggtttggttcgtcaaagatgtctcgtgcacagacatttcccagctacgccccagaacagagtgaagaggcccagcagccgttgtcgcggtccagcagctatggattcagctacagctccagcctcatccaatgacacacagagagccgctgttgactagagagacagtctgtcctggacccgtctgtggggtcattaccctctgcctcctggaagaccaattgcagtacaaattgaaatgggtcggctctagccccagtcccattggaaggttaaaaactggagttctgcttccttgattcagtggctaagtcctttatttattgaatttctttgggggaatctatgttttacataaatagaatccaaatcgtatgaacagttatttaaataaacaaaattctttgggtctgacagtaacagaaacctcagcactgggaaaagctgcccacactggggtatgcctgggtgatgggcacctctcactgacctcacagcgcagtccgcccatctgagcacagggtctgtccttagacataatggtgaccctccacaagctctgtggcttttaaagttctgacagggataaatacagtaagctctgcaaatgacatcgtagctgcatataaataaacccagtgacaattaaaggaacatgaaattcagaacacactattaagcagggccctgtagctctactcgtgtgtgtgtgtgcgtgtgtgtgtgtgtgtgtagacaaatggatattgctatatccatctatatataacaagtatatatcaaacatgtgctgagggtgacaggatatgctcacttaaattgttgaaaaccataatttggtgcattaaagttaagattgttatgttgaatagctatttttaaaatagtgctgtaaaaaa

SEQ ID NO: 93030 - DNA, 1164 bp, Homo sapiens
agagctagcaccatgagcttcatttgagcccaggtgtttgagactagcctgagcaacatagtgagaccctatctcaaaacaaacaaaaattccagagcatctttggcttcctaggaaatagcctaaggctgtaaataaaccctggcctcatattcctgttgtcatttactggcgtagtagacaattcataactgggaaaatcctttgggtgtttttttgatgtaggttttatagaatcagaggttccaaaattgtgtttaactgattctatagaagactataaaagtaacaaagcaggcaaacaagaacaaaaacctttgtgccataaaatcactatttaggccaggtgtggtggctcatgcctgtaattccagcactttgagagaggcctaggcgggaggattgcttgagcacaggagctcaagaccagcctgggcaacatagtgggaccccgtctgtacaaaaaaaaattttaattagctgggcgtggtggcaagtgcctgtagtcccagctactcaggaggctgtgacaggaggattgcttgagcccaggaggtcaagacttcaagtgagccataatcatgccactttccagcctgggcaacagagtaagaccctttctcaacaaaaacacaaaaatcactgtttaccttctctaacccttatcattatgtaaacataatttaatagtttaatcagtatgccttattattattttttcctcttattcatttagtatcattttttaaagtatatttttataggcactatagaaccttgctgaaattggctgaggatactcttcagtggggccagaagttcttagcattatttcatacagaattttccatgcatttacctaatatatttatcatctttaatgacattataaaaatacattgaaccagaatgccatagattaactatcctttttaaattttgattcattatatgtagtagaaccttatctctgtgttgataacagtttttctttttcttttttatatttttaatttttaatttaatttaaattttcagacagggtctctgtcgcccaggctggagtgcaatagtgtgatcacagctcactgcagccttgactgcctgggcttaggtgatcctccatctcagcctccctgagtagctgggactacaggtgtgtgc

SEQ ID NO: 93031 - DNA, 377 bp, Homo sapiens
gcacgaggggtgtccaggctggggattggtcgggggacttaaagaaaaaggcaggtctgagggtctgaggagagagagagaggggtggggagggctgggccaggcaccagagtggagaccacaggccagggcagagggcagggctgtgagggcactgtaggctgtggatgggagctggcatttaagaggggagtccatagaccagggcagagggcagggctgtgagggcactgtaggctgtggatgggagctggcatttaagaggggagtccatagaccagggcagagggcagggccgtgctgggcactttgggctgtggatgggagctggcatttaagaggggagaccatagaccagggtagagggcagggccgtg

SEQ ID NO: 93032 - DNA, 614 bp, Homo sapiens
gatggatagatgggtgggtggtgggtggataggtgggtaggtgggtggatggatgtatgcatgtctggatggatggatggatggatggatggaaggaatgatggatggatggacggacagatgaacagatggacttgagcatttattcagggtcctccaaagaattgagtgatttcctagggtgtaacatcacctgcacgtgggtgggcaagggggcttgcctatgtaatactcatgattatgggtagtgctcagccttagtcaccactctcagaacactttattgactaggaaagtcaaaactggcattgacaactagtgcaaattacagctataactaacagaagatgttgagtgatgacagctggacaaccaataatcaataatttggctttgtcatgttgctgccatgctggacaggtagagccacgggttccttgatccttccatcacattgaggatgcttatcaagacttccccaaccatggggacaaggatcttatcaaatacttgcagttcaccccaaatgctcaccctcttcattccacctgcacatgaccttcagctcaaagacatttccagtcctccaggtcagcccttcttccagcctttga

SEQ ID NO: 93033 - DNA, 124 bp, Homo sapiens
ggggaaaaggggatggggcaggggagcatgggggagggtccccaaagagagaaagggaaagagaaaaatgtgggtgggcggagacagaggaagaaagatatagttatggagaaatacagacagc

SEQ ID NO: 93034 - DNA, 312 bp, Homo sapiens
ccttggcctctcttaagtgctgggcttacaggtgtgagctagcacgtgcccttcaccctccttttaaagtgaaatttgtgtaagacttagataaaggatatttggaggagaagataaagtcacaaaataattaaccatttaaatttggagaagggaggaaggttagaggacatctaccttaagattttcaatttacagacgaggcagctgagtctccaagctgatgagaattccacaaggccatagagctattaaagagcaaaccttttactgacaaatgagtagtacttattcaacacgtttcataatttt

SEQ ID NO: 93035 - DNA, 197 bp, Homo sapiens
tctcttctggagactagattaggaaataaccgatgtcctggcttgtgcagaaaacataagtatatacatttatatacactgtaagactgaaatttgaaacgtgtgcatgtgtatgtaatatatatatatataacatgggagaggctggttgggagaattgggatgtttaatactccactctattccagcccaggggc

SEQ ID NO: 93036 - DNA, 379 bp, Homo sapiens
ttggcaacaagcgaaggggaggtattaaaaatcaagaggtcaataggtcttgtttctaaataaaatttcccagagggcttccccacccccccggcaaatcaaaagacaccttctgaaagcaaagaggcctccaaggcatgggttgccagcctggcttactgtccccacatggcctcggagacaacaagcaagtcactgcctcctattcctgtaggtttcacatgtagaatgagacaggccttctccttgggctcccgtccctgactcctaactctcagttctccattcagagatagggagagagaaacattatctcctcaaacttccaaacaaggtgtccttatttctctcccaggggcatatgcactccaatttgtca

SEQ ID NO: 93037 - DNA, 514 bp, Homo sapiens
ctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataatt

SEQ ID NO: 93038 - DNA, 222 bp, Homo sapiens
cagcaaatatagaagcagcaactctcctacctgacgtgtgcaactgggagttggtgaattcctaaaattggttaaggcagaaagccgtaaaaacaagatacacatgccctgagcattttgtaaaacacaagcccattgtcgttcaccagccagtgggccgctgcccagagccatgtcttgactggggtccactccttggaattcaagttggtttttctctca

SEQ ID NO: 93039 - DNA, 260 bp, Homo sapiens
agtgttaggaaaatcgaatgagataatacaggtgagatccttagcaaggcgcctggcacgcaggaaacgctggataaatgcattgctatcattccctggctgtccccctccttgactggggcagggatcagggcatatgctgaaccatctcccttctccagcctaaggccatttagccagactagaagaagactcggggggatggaatatgtgtcttggaggagacttggaaccattttcgtaagtctccagaagccatg

SEQ ID NO: 93040 - DNA, 738 bp, Homo sapiens
tgaagtttaaagtatttttattagtttttgaaactaatattagacaataaccagcaaatgatatgattccattccattatacacaaaaccaaccaactacaccaaaaaagacaaaaacaaaaccaacaaacatagccctttcttgtttaactgcattttgttcaatgttttaagctctagaaggggaatctttgagttaatcaggtaggaccctcattttgcaaatgagagacatgaggcacaagtaggtcaatgacttattgaggtacttggagagcgaggcagtgtcctctgcccatcgcagctggccaggccttgcaggaggagacacacccaaaagaaatgtagaggccagttctaccacattcatttcacgccctggggctcgcacccttaaaaagcattcattgcagaacagagaagtacattttgaacaggagtagagtagttaaacatgtaccaatgtgcacattaaaaagcaaaataaaatgcagcattgtcagagtcctcatggaaactagaactctctttaaccaaaactactttttagtcattcagtatcacatatcttttatgttgcttacggtaaacgtcaggtaaatcatgatatttatgctttaattttatttaccaaaaatatttttttccttatgggatttaaaagcacatattcttagcttgtgcacaatagctcatgcctgtaatcccagaactttgggagacagagctgggaggatc

SEQ ID NO: 93041 - DNA, 396 bp, Homo sapiens
cctttagaaccttagaaataaaaacttttgtggcggtagaggcactgctaactgattcaaaaattaattaggttttgcctgtgggtgtgaggaatgcagaaaattaatgctttagcttttctgcagttttggtgtcggggagaggttccaagcaaactctattaaatggggatttttttttccccataaccacctgaatgtgatttgtgggcttatgtgttctgatttgaacttcatatagcaaggttgtggcttttggcagatgcagtatgttctgagcgcggctcctagagtctacaatttggagtccaggaaggggtggctgtggagacaagtgagttttgtacctccgtaagccaccctttttcagggtcagttcatgtgttagtatcaggg

SEQ ID NO: 93042 - DNA, 299 bp, Homo sapiens
gtaatctcttgccactttgactccagttttccctaactttgatctactttcacagtgtaggtcttttaagacacagatgtgcacacacttgctcagaattcctctgttgctccctttgacctacagagtaaaacccaaactcattaccatagcattcacagctctttatgatctggcccctgcccctcatttctataactgcattttgctcctgattactgagttaactggcatttcctggaacatactgtgctgtttgccacacctgtgacttgcacatggtaatctttctgcttgga

SEQ ID NO: 93043 - DNA, 2088 bp, Homo sapiens
cacccatccaggcacctctcagcacagcagagctttccagaggaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaagtttctacgtggaatttggacactttggccttccaggaactgaagtccgagctaactgaagttcctgcttcccgaattttgaaggagagcccatctggctatctcaggagtggagagggagacaccggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaaa

SEQ ID NO: 93044 - DNA, 516 bp, Homo sapiens
tctgttttagtggtactgaaatttaaggatatagtagtgaactggaggtttctcattctataatttggatcaatgtatttaatgtaagaattacccataaattttgcagttgaaaatgaagttttgttttcacaataccttcccacccaacccaaagtacacaggcaactgtaagaaaatgattggtcaggtatacataaagattggtggaggcaaagattattcaaacaggacacagactggttacatgtatttccagcccaatctggcaaacatctgcaagaaaaagttgtgccatttactgtacattcacctccatttctgcatgtgttgtacccacaggctgtcccatcacagtcacctacatttgagccaccttttgctccaaattcagttaattgtaattcttgattatttatgataacttgtcggatacagccttgaaaacctacaggttcattttctattgccatgggatttacaagatttaaagaagatactcctccaatatagaag

SEQ ID NO: 93045 - DNA, 576 bp, Homo sapiens
gaaaccctctgcagcctcccagccaggcctgcagacagcggatggtctgtctgtgcctccctgggcataccccagctgattgggtcatgctgttgcccctcagtagtacacaccccttgcttcctcctctgagatctccccactgtggtcctcagcctgcctgtttcgcctttctctcctgtgcaggttaccaattcaaagtccctaagaaagtggctcatctagcacagggtgcctctggtggccaggaccccctgccaggcccactcttgtactgtttgttgttggagagatgagggcaggcactccctagccacccagctgtgccagtgttggcctgctcacacgtgggttgtaggcgtgcctggaacaaaacaattggtaagtcctggcagctcctaaatgaatgtaactggattctgcttccttcttggtttgccatatatggagagaactttgctttctgaaaaattttaaagggaatgaggtaatttcctcataattcctaagatctccggcagtgttgtaaatttagatttgaggttagagtactaatgagtgtaagcaaaagcagaa

SEQ ID NO: 93046 - DNA, 212 bp, Homo sapiens
tatctctgtgcagggccagacatggggatgagattctgataatttgggaatgaatcaggcccccagcccctcctccctcagactcagcagtccaggcacccggccctcctccctcggacccagaagtccatgctcccagcccctcctcccttggacccaggagtccaggcccccagcccctcctccctcagacccaggagtccaggccccca

SEQ ID NO: 93047 - DNA, 464 bp, Homo sapiens
gatatgtcctgaaggtacattactataataataatcaaggactgctaacaatcatacactattgaatatgtttctattctgagtatcattccaaattgaggctggatgtttttacatccatgtgaaatgcaagaacttatattgcaataattttttcctgttagacataaatattctttattcataatgcaaagacagaaattttaattttctgataatgttgtttgtaattgaattctgtgatgttttgaaattagcttatatggtgtttttaagccccttctgtctttgaaattctccaagccagcatactgtcatattcctgtagtcccagctactagggaggctgagggtgaaggatggcttgaggccagtaatttgaggctctagtgtgctatgatggcgcctgtgaatagctactgaactccagccgggacaacatagtggaaccccgtctctaggaa

SEQ ID NO: 93048 - DNA, 597 bp, Homo sapiens
cctttttcatctgtggactctttcctcacctctcccttctcccttcccaccctataggaactaggatgctgatgatagttggtttgacaggtttagaagtgatgcctgctctgctcttctgacctcaaggttctgccaagactgatttttatcccaagttctgatttctccaacaagagcttatgagctaaccagggctgtcagttaggactttaacctctcctggggcaccagaagggtgcttccctgatgggagcatcagtgtcttcccccttctcctgccctctctcctccccgtggggagtgttctcatctatatcctttctgagccatggtggcatctgggagacattcagttatcatatgagatgggaggaaatggaacagtctatgcaatttgctgtttttaacactgccctaactttatttttatctggttaatgtgtctgttggcagtaagaggtttttaatctcctaataagtgtataccaatccaaaagaagctggaataaggtggggagaaggggttgataaattcctgcagcatctttatattccaactagctgtttctgaaaggtgactctttctcttactca

SEQ ID NO: 93049 - DNA, 421 bp, Homo sapiens
attgatttgcatgctgcatgggtcattgctgcagagagtcctcatactggaaagcaagtgctgaagtgtgaagaacgtgcctgtttgtgtctcttcgctcagtccacaggcctgtgtcttctcctggcttggggctagctgttttttagaaggtttaaatctgaccttacactgccatctaatggaaaacatatctgttcagggtggcaggaattgtccgtgactgaaactgtgtgtttcgattcctcgatgaaaacatttcgtgagtttacacagtagggtctctgtcactttcagtcctaactctgtgctagtggatttaaaatgcaggcttggtttgaagtactcagagcgtatgttgctttttctgatgtgtctgagccgggacttcacttggaaatgtagaatccgaaatccagtt

SEQ ID NO: 93050 - DNA, 2099 bp, Homo sapiens
  misc_feature (151)..(152): n is a, c, g, or t
atgcgcagaccgaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcanngatggcgcggccgccccggcagcacccgggggtctgggcgtcgctgctcctgctgctactgacggggcccgccgcctgcgcagccagccccgcggacgacggtgcgggcccggggggccggggaccccggggacgcgcgcggggggacacgggcgccgacgaggcggtgccgcgccacgactcctcctacggcaccttcgcgggggagttctacgacctgcgctacctgtcggaggagggttaccccttccctactgctcctcctgtggatccatttgccaaaatcaaagtggacgactgtggaaaaactaagggatgctttagatatggcaaaccaggctgtaatgcagagacctgtgactatttcctcagctaccggatgataggggctgatgtagaatttgagctgagtgcagacacagatggttgggtagcagttggattctcttcagacaagaaaatgggtggtgatgatgtcatggcctgcgtccatgatgacaatggcagggtccgcatacagcacttctataatgtaggccagtgggcaaaggagattcagagaaaccctgccagagatgaagaaggagtttttgagaacaatcgcgtcacctgcagatttaaacgccctgtgaatgttcccagagatgaaacaattgttgatctgcatttgagttggtattatctgtttgcttggggtccagccattcagggctctatcactcgacatgatatagactcaccgccggcttcagagcgtgttgtcagtatttacaagtatgaagacatttttatgccatcagctgcctatcaaaccttctcatctccattttgtttgcttctgattgttgctctgaccttctacctattgatgggaaccccctaaccacagctgcagggccaacagattacatggattgggaagtctttagtataaatatattttttaaagaatatccagtataattttagcttcaattatttaagaaaaaaaacctcatataatttcagctttttggaagaaagaacaagcttcttttgtagtcaaagaagattgtttaataatgaccctatacttttggaacatacttacaccttttctaagcactttcacatatgttttcttatttaacttcacaacatctctgagttggattgatgaaaattgtgattgccatcttcctgaatgggatttgagacccaaaaagactgcctttttatgatccacataccatataactttggctagaaatgacaaatagaaaggcagagaaggaactaagtatagaaatcatgtctcaaaacagtctttactatgagtgctatagcacagagagttattttgaatattactagggagaactttactgaatgtcataagttcacagtcagccttttgggcagaagaaatttcaaatttccgtaaagcagaagtgcttttggatatttacacagccaatggggagattggaggaaaatacaatgatatgaaaatagttcatatttatttgaaattttggccgagcatggtggctcacgcctgtgatcccagcactttaggaggccaagacgggcaggtcacctgaggtcaggagttcgagaccagcctggccaatgtggtgaaacccccgtctctattaaaaagtacaaaaatgagccaggcgtggtggtgcacacctataatcccagctattcgggaggctgaggcaggagaattgctggaacccaggaggcggaggttgcagtgagccgagattgtgccagtgcactccagcctaggtgacagagccagactctgtctcaaaaataactaactaaataaataatatttatttgaaatttcttctcagttagagagcagctatgggaaaacatttttactgctatttgcaaaggttggagaccaaactgtgagcattcctgaagatgtaaagttgtgttaatgatatt

SEQ ID NO: 93051 - DNA, 641 bp, Homo sapiens
  misc_feature (151)..(152): n is a, c, g, or t
atgcgcagaccgaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcanngatggcgcggccgccccggcagcacccgggggtctgggcgtcgctgctcctgctgctactgacggggcccgccgcctgcgcagccagccccgcggacgacggtgcgggcccggggggccggggaccccggggacgcgcgcggggggacacgggcgccgacgaggcggtgccgcgccacgactcctcctacggcaccttcgcgggggagttctacgacctgcgctacctgtcggaggagggttaccccttccctactgctcctcctgtggatccatttgccaaaatcaaagtggacgactgtggaaaaactaagggatgctttaggcaagattctgcatttctaataagctccctggtcatgctggttcattgatgacctcattttgggtggcaagtctctgcagcatttgcccagcaaagacccaaggatatcatgagaccttttagagactgctaaaatcaagttacactgagtcttgagcattcctt

SEQ ID NO: 93052 - DNA, 303 bp, Homo sapiens
tcttaaagccataatttaaaaaaggcggaagggataggatgtaaggttgaaccacatgggaaaaataagtcagggaaaaataagtcaaggaaaaataaccaccaggtgcagaggctcacacctgtactcccagcactttgggacgccaaagtgggtgggaggatcacttgatcccatgagttccaggccagcctgggcaacatagtgagacctcatctctacacacacacatacatatacacacacacacatatacacacacacagacacaaacacatacaaaaactagccaggtgttggtgg

SEQ ID NO: 93053 - DNA, 588 bp, Homo sapiens
gagtccagcacgggaggcgtggtcttgtagttgttctccggctgcccattgctctcccactccacggcgatgtcgctgggatagaagcctttgaccaggcaggtcaggctgacctggttcttggtcagctcatcccgggatgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcacatgtacactgcacgttgtacgacgacgcaccgaggccatacctggcattcctgcggtacgactatagagatctcctccccagcctccggtcctggcctcgtcgatacctgtgtacagaagtgagccaccatccatgccgctaacagtcggtaccgagctcgattgatc

SEQ ID NO: 93054 - DNA, 279 bp, Homo sapiens
ctccacctgctgtgttcaagagattctcctgcctcagcctcccaactagctgggattacaggtgcccgccaacacgcccggctagtttttgtatttttagtagagatgaggtttcaccgtgtcggccagctgttctccaactcctgatctcaagtgatctgcccgcctccacctcccaaagtgctgggattacaggcatgagccgccatgcccggccaggtttcagatttattcttgtatcccagtagttcattctgttaaagccacatttggctttgg

SEQ ID NO: 93055 - DNA, 463 bp, Homo sapiens
ctgagctgaagcctcgtccctggtgtggcctcccaggctgccctgagcagacccctcaggcagaaacctgtcatgcaccagctctccctccccctcacttccttctccctagggctgggctacaggccttgctaggggcttctttaggaaccctcctgggtgactgaaagcagctctgggatgggagaccgtttgggaccttgtctgagaatcctaccaccacacacgtattttgagagaggaagtggggccaaggcaggctccctgacattccggccgttcagagccggctgactcggaagccagaggagccaagcttctaccaggtcctcccctgcccagaccactgctttgacgctttcttcctcaaatagcatttacccagaaggcacatgtgtctgagtcatctcctctatctaagggttctgggtctctctctgctttgggtccatggggcttgtgg

SEQ ID NO: 93056 - DNA, 131 bp, Homo sapiens
attaaaggagtagctctttgattatctaccagtaggatgcaaaaatgattaaatagtgttttatttaaaatattttacattttattaaaccaccttggcttctgactactcctaactcacctcgcctttag

SEQ ID NO: 93057 - DNA, 342 bp, Homo sapiens
cctttcacacatatttttcagattaagcaaaatacaatttattccactgaatagaaaacgttgccttccatatctgtctttgaatttgtagtcgttccgattataatttgagttctcaaacatttgaattacacagtctcttggttcactccgacaggtgtttaaacaggtgtgcgtaggtctttctacttcagctctcagagccggtcttgtttgcaggttagtgggtggcgcacctcgcggttgctcccaccccacccttagtaacagggtttgagtaggaccctggggtgggggagtggatgctgctgtttcaagctcgttcgcccaaatacatctttc

SEQ ID NO: 93058 - DNA, 442 bp, Homo sapiens
aactctgtgagttccagccacatcttctttcagttcctcaaacacctcctgtctctcctccaggaggtttttgtgtaaactctactcaaatgcccttgactacctctggccaccctctgactaaccctccttacccctcaaacctcacactttgcctggatcacttctactgacctcagtttaaatgtcacatctttgggtcagattttcttgtcacctgctctcctaaaacccttttcctcttcagcatttatcaccctaataaataataagctggagctaagataataatggctatggaatatatgtctcccctactagactgtaacctccattatgaaaggactcttttgatttggttcattcctaaaccctgagcaccaactgcagggcctggaatacagaaataatgaatgaatgaatatgtccaagatgtactaaa

SEQ ID NO: 93059 - DNA, 424 bp, Homo sapiens
gtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctca

SEQ ID NO: 93060 - DNA, 342 bp, Homo sapiens
atcatgaaaattatgaagatgaggtaaagtctgttccatttttcctctatttttgagaaatcttagatttatctttaccagtctgtaacccagctttcttgttttatattttaaatatactttctattttgtgacaggagtgaaaaaatgtttaatgattttaaacatgtttatatatatttttcagacttggaacagcagtatctcatgttttactataaaaacttgggtatattacttgaagatcaactatattgttatttttagtatgttagcaattcatctgtcaataatcaccaaagaactcaagaatgaataacatgatctatcaaaaggcctata

SEQ ID NO: 93061 - DNA, 177 bp, Homo sapiens
gatagaagattccccagtctagggggtcttcaagttgggactggcagacccttgagactctttagccagatacctgcacagaaagatgtctttccaactgtcaacaacctaagccaggccaggtgcagtggctcacgcctgtaatcctagcactttgggggctgaggagggtggatc

SEQ ID NO: 93062 - DNA, 384 bp, Homo sapiens
cagggattaattattaattgacagctgttttaagttctgaggcaaactcaggcctccatgcaggaatgatttttaatcacatgagctcagtattggactctgatggctgaagcctcttcctgataaggttatttatgaatggtgggttcaccattaatactggagattactctcctacttctctgtgagagagaaggcaaaccctggctaaagaaaataaatggtttgtatatgatgctctgcttttttaattacaagagttactcctagagatttcaggggcttacttgtcccaggatttgagtcagggtcctgagagagcagggccaaaagtgtgttggaaaaggagcagtactaggctggggacagacccaagctgaggga

SEQ ID NO: 93063 - DNA, 463 bp, Homo sapiens
tgttgttagaaagtatggctcccatctcataaacaattctgaatctgcagcctgcaagccccaacctgggcctgtccttgactgagtttgttcccatcagatactcattgcaaagcttttgggggacgtagcacttgtgttctaagcgggctctgagataacttactggggttccactagtaccttgtgagccattgccactccccctctatgatgacctcgcccagggctaaggggaaaaagcagcagggcccccatggacctatccaaaaggagattaatccagggtactcaggaaaatctgtgttggaaatccctgaaaaaacatggaagcagcatggtgtgtgattcagtacaaactacaaaaaacctggagaaacaaggcttccatgtgagattcgtgggagctctgtgaccttacgccaccagctctaaatcagcattccctcacgtgtttgcataa

SEQ ID NO: 93064 - DNA, 302 bp, Homo sapiens
aagaaattaaagactgtgtaagcaaaaactcagttgtatgtaagaaaacccaattccccttgggaagagaaagggctggagtcctttaaaattaactgtgtttttctctctgtggctagtgagccttatctctccctttcccaggcattgtgaagactgtttctctagctgtgcagctgcaaggacactagacagataatctcaagttgtaaaacatgttgttccttaaaaagtaagaaataatgtaatgcatctcttacttgaataactgtctttgtttctctcttctgtaatacgcttcc

SEQ ID NO: 93065 - DNA, 521 bp, Homo sapiens
  misc_feature (44)..(44): n is a, c, g, or t
  misc_feature (153)..(153): n is a, c, g, or t
aggcatgaaccaccatctccggcctgaagtttatttaatccatngccttgtggactgggcattgaagttgtgtgtagttgggtttttttgttgttgttgctgttgcagacaatactactgtgaacattcttatccatgcttccttgtgtcccntaaatgttccctccagggagataccttggagtgacatgctggtgtgagggatgcatatcataattttaccagatactacagatcttgaaattgttccaattctaccccacaagcaatataagagctctcactcctccaaaactccctgagtctttacttatataatttatgattttgacagtcttacagatttaaaatggtacctaattgtgtacttaatttgtgcttttctgatttcactagtgagattgagattctttttgtatgtccattagcccttcaggcctctgtgatttacccatgatttactgtggtttaataatttttattgggttcttttccttattgatttatgggaacttattata

SEQ ID NO: 93066 - DNA, 251 bp, Homo sapiens
cttgaactcctgacctcaggtgatccacccaccttggcctcccaaagtgctgggattacaggcataagccaccatgcccagccatgttgctgtttttctaagaacatgtgttgacttcatggtttatttgtttattgattttttggagataagatctcactctctcatccaggctagagtgcattggcacaaacatggctcactgcagtctcaaccacctgggatcaactgatcctcccacctcagcctcc

SEQ ID NO: 93067 - DNA, 538 bp, Homo sapiens
tctcaaatgattgcaagatacaagtagaatggagaagcattaattcagcccttctaggtttgagttactcactctgcccacctctagagcattctatggcagggagattaaagtgtctcctaactatgcagtcactgataaaataagaattagcacattctcactaaatgaacatgactttaaggcacaagtatagattcctgaaaaagttctaagctgaacctgtacaaatggaatcattttaaacacaccatttactgtcacacagactccctgatactttagtgtgtgcacatgtgaaaccatttttttgaagtatgaaataattaattgctcaccattttatctatataactttggattttggtgtcctgagctctctaaaaaccggtgtgtttctatagtatttgaatattatggggtaatagttttgcagagtacagtatgcttatactaaattataacagcatatcctcgtgggtaaccctatttgatagggcagaaagcttgtacactgatcctgaaaagtcatctgata

SEQ ID NO: 93068 - DNA, 436 bp, Homo sapiens
gtcctcagtgcccccttgtcaacatcgggtgtgccttctccagaccagctgccttcctttgacccaccaagatgggactcctccacagtcctggaagagcctgtggccttgacccaagtgccgtggagagacagtttgagcactcctctgaatgggaacagagagcccctgcagggggaaaagttcagcctgtgaaatttctttcccttcaatttccttctccaccgggtcttgctcacacaatgcccatcaaaggtgtagccttggtggtgctttttgcagctgtccacaacacttggtgtgtccattctgcatgaagcgcacacctctgggttgccaccatcctgactggtgcactatagcactgcccctggctgagaggcaggcaggtaggataatatcccacccattcccactggatggaactctactgtgt

SEQ ID NO: 93069 - DNA, 324 bp, Homo sapiens
cacatgggacggactggagaagctgaggtacagtcatggagctaccggactcctggggggcagcagtggaggccagggaaggccacccttgagtcactcccggggtacattgtgtggccttttgcagtggggcctggcgggctctgacgctggtggatgggctgtgggcacccatttgggggacagacatgtaactcaggcggtggaccccaaaacctgggagaggggctgtggcaaggcaggggcttcagcctcgggcccccatccaccccgcatcctcggcaggtgacttacgggtctctgacacctctgggattccgtact

SEQ ID NO: 93070 - DNA, 1902 bp, Homo sapiens
aatttggaaaatacagaaactacctataatttttccattgttaacatttgagcatatttcttgtcacttttaatggtgctttaaatatgtagcaaatgtatcatttcgtattttaaaaaaatgctaggtaagcatttcctcctgtccttaaaaagctcttttaaacaactttaaaatattgtatagatagatgtacacaattttctgaataattggagttatatttacatcttttcactctttaggaaaggactggcctgtttctgtgttgggttccttcctgagtgtggcttccagctcagtggctcagacttcaagatgaagacttcagtcctggttgtgtatggtcttgggccagttaccatatgtctaatgaatacttagttttgtcatctacaaaatgaaaatagtaatatttgcctcaaagactattatttgggaggatctagtgcaaatgttagtaatgtggatattgtgtagtgtcccaggatattaatgtttttagcctcttggcttttattctgtattgttgccccaaaagatgatgctcacttatctttcatccagtgtaaggatatctggaaagacaacagaaagtatagctgttttcatttcaaaagtgatcagctgcttgagctagcaagcaaggcttgcactagcttccaggcgcagtcacgcagtttcacagcaggcgcggttccctcggagcacccagagctgccctgcggtagtcagcagttgtgctgtggctgcactgccaggctgggtggcaggtggatcggagccagcagatgtggctcaggaagtgccttcttggcctctccttaatctctttcagagtctgtgggcccttgattgcactgtgggttgtttcagactccagtattaggagactgaaccccttggtggtttttttgtgtgtgtgtgctgagctgggttgaggacatgttaagcaggtggggtgcctcccctgggtttgctccgggtggtacctgtggtgtggggtggttctgagtagttctggccccactgctggagtatctgcccactcagtttgtgagatggcagggcttcatcctggtctggtgcctcattttcttctttagcagtgggcttagaaccaatgcagattcccaagttaagtattttttctgtagcttaattattacaggcttctggtacctaagccctttcttactttctgttctgaggggaagagaagataatgttgtttctccgccccccccggagtggccccaggaccttgcatggcatttgcagcatttgcagcgtgcttgggtttgctttactagggtgaaagtgttgcaccccccagcacccacaaaggcacctctggctcaccctccggtgaggttctgactggccctgggacatcacctgctccaggatcctatgtggctcatcccaggagagatgtgggagggaaggggaaaaaaggcttacatttgctgagtggaattcatgtagatctgagttccgcattgattcctaagctgcagagcccttatgccttggctgttttgtgaatgttagtcggtcttaacctttttcaccgagttagcattggctgtctcaggaggctcacagctcctgctcctcctccaggggagtgcgccctcctcctctgtcggtagctgtcaggtgcccctttcctctgcagcagactgtcctgggtccttgcctggccttccccttacacgtgagcctgcagcttcattcacagcccctgtgtagaaagataggcacatcgataggtccctccctgcccagagtgggcggaactgaggcaggcactaaaagcagctgactggcagccctagaaacatgaagggtttcatttatagtttcagtccttttccttctttcgagccttaatttaaa

SEQ ID NO: 93071 - DNA, 1539 bp, Homo sapiens
tagaggatccccagtccgtcgaatgagcatctacaaaatgaaaatagtaatatttgcctcaaagactattatttgggaggatctagtgcaaatgttagtaatgtggatattgtgtagtgtcccaggatattaatgtttttagcctcttggcttttattctgtattgttgccccaaaagatgatgctcacttatctttcatccagtgtaaggatatctggaaagacaacagaaagtatagctgttttcatttcaaaagtgatcagctgcttgagctagcaagcaaggcttgcactagcttccaggcgcagtcacgcagtttcacagcaggcgcggttccctcggagcacccagagctgccctgcggtagtcagcagttgtgctgtggctgcactgccaggctgggtggcaggtggatcggagccagcagatgtggctcaggaagtgccttcttggcctctccttaatctctttcagagtctgtgggcccttgattgcactgtgggttgtttcagactccagtattaggagactgaaccccttggtggtttttttgtgtgtgtgtgctgagctgggttgaggacatgttaagcaggtggggtgcctcccctgggtttgctccgggtggtacctgtggtgtggggtggttctgagtagttctggccccactgctggagtatctgcccactcagtttgtgagatggcagggcttcatcctggtctggtgcctcattttcttctttagcagtgggcttagaaccaatgcagattcccaagttaagtattttttctgtagcttaattattacaggcttctggtacctaagccctttcttactttctgttctgaggggaagagaagataatgttgtttctccgccccccccggagtggccccaggaccttgcatggcatttgcagcatttgcagcgtgcttgggtttgctttactagggtgaaagtgttgcaccccccagcacccacaaaggcacctctggctcaccctccggtgaggttctgactggccctgggacatcacctgctccaggatcctatgtggctcatcccaggagagatgtgggagggaaggggaaaaaaggcttacatttgctgagtggaattcatgtagatctgagttccgcattgattcctaagctgcagagcccttatgccttggctgttttgtgaatgttagtcggtcttaacctttttcaccgagttagcattggctgtctcaggaggctcacagctcctgctcctcctccaggggagtgcgccctcctcctctgtcggtagctgtcaggtgcccctttcctctgcagcagactgtcctgggtccttgcctggccttccccttacacgtgagcctgcagcttcattcacagcccctgtgtagaaagataggcacatcgataggtccctccctgcccagagtgggcggaactgaggcaggcactaaaagcagctgactggcagccctagaaacatgaagggtttcatttatagtttcagtccttttccttctttcgagccttaatttaaa

SEQ ID NO: 93072 - DNA, 434 bp, Homo sapiens
gtacatgaatttgcccattacattttgctactttgagacattagaagacctctcaagaagtccgaacctttctgttgagacttgttcttagatgagacaaatctgatctctcaaaaagatgaggttctcctaaaaacagtgtgtcagttctctgtgaacttgggaaaaattgtgaaacagagaccttgattccctattcagacctcccatatacagaattcatgagtgtcagctaggatctgtccccagatattgcatgggcttcatctcttgatactatggacaacttttggtagaggaggtagaggataaaagaaaataagagatcacctgcaatcttagtgcagactgtaaggagttcagagaaagtgccagccttcaggaaatgtcaggacaagtgttagctcaattcagtaaccaaattcagttcaatt

SEQ ID NO: 93073 - DNA, 911 bp, Homo sapiens
tggagacagtctcactctgttgcccaggctgcaatgcactggcactatcttagctcaccgcaatctctgtctcccgggttcaagcgattctcgtgcctcagcctcccaggtagctgggattacaggggcgcgccaccacacccagataatttttgtactttttagtagagatggggtttcaccacgttggccaggctggtctcaaactgctggcctcaagtgatccccttccctctgcctcctaaagtgctgggattacaggtgtgagccaccgtgcccagcctgacgtgttcaaagtagttatacatacagctggtatatgacaattatgatttaataaatctaatcctatttggcaaagggatagcctagggtagtgttcgaaagtcagcccacccaagttatgttcttaaacccaagcacccttatatagacattacacactggattccttaaaaaaacaacaacaaattcatgtaaaataaaacatagaaacagattctgcacacaaacgtagggcttaatgaattacactaagaccaatacccttggtaactcctaccaggttaaaagaactttgtcaccacttcagaagccaggtccctatcacaatctcctccctcttcccatatatttcccttcatagaaccacaggtattctatgcttctatttttacgttcacagaatttccttgcaggtttttttttttttttaattacccaagtttgggtgaccccagcgcttagcatcacttaaaaaattgttttggcattagtcttctttcttactataatgctaatagaataaacgatgtctacactgattttgtaaagaaaaactagccatagtagtaaatcatttactgtctaacatgatgcaaatttcaactttgaataagtaagtcttacac

SEQ ID NO: 93074 - DNA, 663 bp, Homo sapiens
taatattaagaaagctctaacacaagagtttacaatttcaaagagtacaaaaaagtgctgcctgctgtcccttctcatattttagttgtaccctagtgatcttgacttcttttacatttagacaaaggctatttttttaacaaataataagcaaatgttctccattatgctaatgaaaccattttaatcaactagacgtggcctgaaaagcaaaggcttttgccatccaattgctgccacaaataatggcttacttgacatgaaagatgtcaaaattatcatttttggaagacattatccaaaattaaattgggttaattccacaaaattctgctcagcaagtctactaattaaatctcatggagtatattttccagccacctattctggcaggctcaccagatagttacaaagtccagaaccaaatattctatagggccatctacagggattttcggtggtttgaatgggtcaatttcaacaccagtaattaaagttttccaaatctaatatttctccattatggtttggaactttaaggtcacaatcaagcaattatataaatgttctacctgacagatccaaagttgctttttggggaagttctagctttgtctaaaaataactttccatagggaggtaggattaccttttctgtaaatt

SEQ ID NO: 93075 - DNA, 2396 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93076 - DNA, 694 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagcctctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93077 - DNA, 448 bp, Homo sapiens
aacagaaggaaaatatcaagtgaggttaaattgcgttacaggcagggtgacaagtcctaatgatgttaatatggcggtcagtgaaatgtgaatcgactcgcaaaagggacactttgggacggggtccgcccacagtgtctctctctatctctctctctctctctctctctctctctctctctctctctctctctctctctctctctctctctctctctctctctctcctcgtgccgaattcggctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93078 - DNA, 764 bp, Homo sapiens
cagtacggatgtgtgatcgaaaacccggctggtctgagcagcgtctatagaataggtaaagtaataccaagggctttttatcatttccttcttccctttaagtttcacttgaaattttaaaaatcatgtttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaatctgaaactgtaaaagtagatggttgaaagcactggcccgcacatccgtactggcccggggccagctgcgtatgtggcccaggggaggagtgtggtccctctgtgtgcattccctggaatgtggaacttcctagatgccaccctcctcttggagagcagtggctggtcttacttttttattgtactttcagtgtctgccacacagcacaggcccagtgaaagtggaccaagacccagctgcgtacaagtacttgcaggaataagcaggtacctgcatgaatgagcacagagcttgcaggagaggcctggggtatcttggtgcaccaggccacggggtcaaatttacctgccttcctggcaagagatcacaagaaatattcccaggttcacatgtaagaatgtttgctgcagtactatctataaaattaaagtattggaaactagact

SEQ ID NO: 93079 - DNA, 2556 bp, Homo sapiens
  misc_feature (2403)..(2403): n is a, c, g, or t
  misc_feature (2407)..(2407): n is a, c, g, or t
  misc_feature (2421)..(2421): n is a, c, g, or t
  misc_feature (2423)..(2423): n is a, c, g, or t
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaanaaanagagagagagagananagagagagagagccagcgccacagccacagacagtcagcccgagagagtagacagtgccgtcccataccacatagccttccgcatgtcggccgcctcgcgcgttatcttactttcgtcgggcgggtgacccaa

SEQ ID NO: 93080 - DNA, 2288 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaattgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93081 - DNA, 2260 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccaggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93082 - DNA, 2037 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagcctggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93083 - DNA, 1697 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggcgaccagtgcatagccaactagaagtaaaaaaaacttgagggggggcccgagacccaatgccccctatctcgagtcggataacaattcaatggccagcgttttacaacatcgacactggcaaaacgctggctttacccaacttaatcgcgtt

SEQ ID NO: 93084 - DNA, 1883 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaagggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93085 - DNA, 1376 bp, Homo sapiens
gatcccccgggctgcatgaattcggcacgttacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93086 - DNA, 668 bp, Homo sapiens
gctgagatcatcgtatgcaacagctgggtaataagactagcatagctcaaactatcctgccaaacgctctcatctgattttttcctcccttctcccccaacctccaatcaccctgaagtaaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93087 - DNA, 2576 bp, Homo sapiens
  misc_feature (2403)..(2403): n is a, c, g, or t
  misc_feature (2407)..(2407): n is a, c, g, or t
  misc_feature (2421)..(2421): n is a, c, g, or t
  misc_feature (2423)..(2423): n is a, c, g, or t
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaanaaanagagagagagagananagagagagagagagagagagagagagatagagagagacatacagatacagatacggtgagactactcttattcacatagatacttatctcactctaacttcactttcactctttccctgttacttttcctctctcctcctctctcttctctct

SEQ ID NO: 93088 - DNA, 2416 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaacctcgtgccg

SEQ ID NO: 93089 - DNA, 2451 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93090 - DNA, 735 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 93091 - DNA, 679 bp, Homo sapiens
caggcagctgccaggagctcttccctgctcgctcacgcctgagcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcatgtctgccacacagcacaggcccagtgaaagtggaccaagacccagctgcgtacaagtacttgcaggaataagcaggtacctgcatgaatgagcacagagcttgcaggagaggcctggggtatcttggtgcaccaggccacggggtcaaatttacctgccttcctggcaagagatcacaagaaatattcccaggttcacatgtaagaatgtttgctgcagtactatctataaaattaaagtattggaaactagact

SEQ ID NO: 93092 - DNA, 266 bp, Homo sapiens
atgggcacatccatggaagagtaagtctcagactcctggaggccaggggaagtgccaagcaagggcaccaatagtgggaaggcaatagggggtcctagtgaggaattattctctcttttgtttctcttgggctttttaagtacttctcaccccccaggtttagctgcacccttcttctttccctttgaatcagaacgtggatttgggctaggctcagtggctctcagcactttgggaggtcaagtggatggactgcttaagcccca

SEQ ID NO: 93093 - DNA, 715 bp, Homo sapiens
acttttataacacagtccaaataccatgcctttggaagtcttcattgcttacttaatcaccctaacacactttctcaaataccccccaaacaatactagagtggattagattttcggtgcttacctctgttattcaatgtaccatgttttactattaatatgtttgtcttccttactagattgtaagctccctctgggcttgggccatcatttatttgattttctgttcccagtgcctgacgtattgccagaacataagggaactctcagtgaatgcttgaatgaatgccacaggattctatgttaaggcttgacctattaaatatttagaaccaatgacttgtataaggacacataaacaacctatgaaatttgccaatagtagaaaccgagaggactaacaactcattttatgtcaggaggttaggagaatgggccaaatgtatcatgaagaaatttagctgatagaaatatacaattctatgtctgaattacaaaaatcagtaacataccagcctaggcaatatgatgaaaccccgtctctacaaaaaatacaaaaattagccaggcatagtggcacatgtcagtagtcctagctacttggaaggccaaggtaggaggatcacttgagcctgggaggttgagtctgcagtgagccaagattgcaccactgcactccagcctgggcaatagatagaatgagaccctgtcttga

SEQ ID NO: 93094 - DNA, 1067 bp, Homo sapiens
aaggtcggacggaagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaacgcaaaaaatacggcttcaagaagaggtgattggtgggtggccccttcctccccccaacatcagtctgctgcagctgccagaaaacatgcctactactaccagcagaaagggagcagagcccagagcatcaccaggagtgcctgctagtgtactggcagcttgccaccccctcctctcccttcacccagacacgtggtagggatggaaaaggattcttcacagagcactctggcacaccatatcggagaaaacttgatagattagttaatggtttttcttgaattcgagaagcatagatctgttctccatattggtatgttctccctcaaccaagatcttctaaaaagaaataatattttagtcttctgcttgaggaactgactgtgaagcgacgcccagtgaaaaacatgttcttgcagcagctctggtggcagctgtccttgaggaacctttggtgtgtggtgggaagctatcagaacaagaaatgtaggcatttcccgtttttttggggggggggggtgggggggcagggctctgccctcttgaaaggcatttacttgtttaacacttgtccagctacagtggggtacagtagctggctattcacaggcatcatcatagcccactagtctcatattattttccttttgagaaattggaaactctttctgttgctattatattaataaagttggtgtttattttctggta

SEQ ID NO: 93095 - DNA, 1294 bp, Homo sapiens
aaggtcggacggaagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaacgcaaaaaatacggcttcaagaagaggtgattggtgggtggccccttcctccccccaacatcagtctgctgcagctgccagaaaacatgcctactactaccagcagaaagggagcagagcccagagcatcaccaggagtgcctgctagtgtactggcagcttgccaccccctcctctcccttcacccagacacgtggtagggatggaaaaggattcttcacagagcactctggcacaccatatcggagaaaacttgatagattagttaatggtttttcttgaattcgagaagcatagatctgttctccatattggtatgttctccctcaaccaagatcttctaaaaagaaataatattttagtcttctgcttgaggaactgactgtgaagcgacgcccagtgaaaaacatgttcttgcagcagctctggtggcagctgtccttgaggaacctttggtgtgtggtgggaagctatcagaacaagaaatgtaggcatttcccgtttttttggggggggggggtgggggggcagggctctgccctcttgaaaggcatttacttgtttaacacttgtccagctacagtggggtacagtagctggctattcacaggcatcatcatagcccactagtctcatattattttccttttgagaaattggaaactctttctgttgctattatattaataaagttggtgtttattttctggtagtcaccttccccatttaactttaactctaggaatttattttagtcacccaggaatttgtgattcaaaacagaggtagtgggattggttaagtactttgtcctcttattaccactggaaggaattcaaaaccacccatacctttcattatagatagatcaaagtcatctttagaaacgtactattttttccttcctgtccaactttaattttgaactgaagagatagc

SEQ ID NO: 93096 - DNA, 995 bp, Homo sapiens
aaggtcggacggaagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaacgcaaaaaatacggcttcaagaagaggtgattggtgggtggccccttcctccccccaacatcagtctgctgcagctgccagaaaacatgcctactactaccagcagaaagggagcagagcccagagcatcaccaggagtgcctgctagtgtactggcagcttgccaccccctcctctcccttcacccagacacgtggtagggatggaaaaggattcttcacagagcactctggcacaccatatcggagaaaacttgatagattagttaatggtttttcttgaattcgagaagcatagatctgttctccatattggtatgttctccctcaaccaagatcttctaaaaagaaataatattttagtcttctgcttgaggaactttggtgtgtggtgggaagctatcagaacaagaaatgtaggcatttcccgtttttttggggggggggggtgggggggcagggctctgccctcttgaaaggcatttacttgtttaacacttgtccagctacagtggggtacagtagctggctattcacaggcatcatcatagcccactagtctcatattattttccttttgagaaattggaaactctttctgttgctattatattaataaagttggtgtttattttctggta

SEQ ID NO: 93097 - DNA, 845 bp, Homo sapiens
aaggtcggacggaagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaacgcaaaaaatacggcttcaagaagaggtgattggtgggtggccccttcctccccccaacatcagtctgctgcagctgccagaaaacatgccctcttgaaaggcatttacttgtttaacacttgtccagctacagtggggtacagtagctggctattcacaggcatcatcatagcccactagtctcatattattttccttttgagaaattggaaactctttctgttgctattatattaataaagttggtgtttattttctggtagtcaccttccccatttaactttaactctaggaatttattttagtcacccaggaatttgtgattcaaaacagaggtagtgggattggttaagtactttgtcctcttattaccactggaaggaattcaaaaccacccatacctttcattatagatagatcaaagtcatctttagaaacgtactattttttccttcctgtccaactttaattttgaactgaagagatagc

SEQ ID NO: 93098 - DNA, 552 bp, Homo sapiens
  misc_feature (427)..(427): n is a, c, g, or t
aaggtcggacggaagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaacgcaaaaaatacggcttcaagaagaggtgattggtgggtggccccttcctccccccaacattcaagtgcttngccgtgcaagctaggcccagaaaaaaaacccaaatttgacccccttaaaccttaaacctttaaaaccccaaagcccaaaggaacaaaacgggggacggcaagaaagggcccaaggaagcattcac

SEQ ID NO: 93099 - DNA, 1139 bp, Homo sapiens
aaggtcggacggaagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaacgcaaaaaatacggcttcaagaagaggtgattggtgggtggccccttcctccccccaacatcagtctgctgcagctgccagaaaacatgcctactactaccagcagaaagggagcagagcccagagcatcaccaggagtgcctgctagtgtactggcagcttgccaccccctcctctcccttcacccagacacgtggtagggatggaaaaggattcttcacagagcactctggcacaccatatcggagaaaacttgatagattagttaatggtttttcttgaattcgagaagcatagatctgttctccatattggtatgttctccctcaaccaagatcttctaaaaagaaataatattttagtcttctgcttgaggaactgactgtgaagcgacgcccagtgaaaaacatgttcttgcagcagctctggtggcagctgtccttgaggaacctttggtgtgtggtgggaagctatcagaacaagaaatgtaggcatttcccgtttttttggcgcaatggattcctggtaaattattcttcctatgacagatgactccgaagcacgttctgaaagttcctctaaaaacctttattactattttaaggacaattatcactcatcacctcggaattccttagcttttaaactgttcagtctccctttacttaggaatgttggcaccccagttaccttccgagtcgtgccgcatgttatatgtcaccactctggctttatttaattctccgcttctattccatttacacagctacccctacataatttt

SEQ ID NO: 93100 - DNA, 390 bp, Homo sapiens
gcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctacttttttttttaaagatctgagagtgtgaatcttccacctccttttcaaccaaagttgaggaatttgtcctgctataatctcaacccttgagtatttctttttttaaaaaattttattattattattattataatactttaagttttagggtacctgtgcacaacgtgcaggtttgttacatttgtatacatgtgccatgttggtgtgtgcacccattaactcgtcattcagcattaggtatattt

SEQ ID NO: 93101 - DNA, 708 bp, Homo sapiens
gctggatattttcagccttcaatttggcattaaggtcattgtgtgtaaagaagagaaaagctgcccgggggcgcggtggctcacgcctgtaatcctagcactttgggaggccgaggcgggtggatcacaaggtcaagagatcgagaccattctggccaacatggtgaaaacccatctctactaaaaatacgaaaattagctgggcgtggtggcatgctcctgtagtcccagctacttgggaggctgaggcagaaaactgcttgaacccgggaggcgggggttgcagtgagccgagattgtaccactgcactccaacctggcgacagagtaagactacaactaaaaaaaaaaaaaaaacacgaattcaaactgacttaaagaaaaacaaaataatgtggagataggcttatgctactgaaaaatctaggcatggctggatacagggtcctagctaatattatcacggtctattttctatctcaagcctctaccttcttctgtgttactttcattctcaggcactatcttagcatgggctgccatagcaaaataccatagactggttggcttaaaccatagaattttatttctcacagttcttgagcctggaaagtccaagatcaatgagctgacaagattgatttttcctcctgaggccttttctcttggcttccaggcagtcattagcttgctgtgtgctcacgtgac

SEQ ID NO: 93102 - DNA, 421 bp, Homo sapiens
catctcatccaaaaacaccctcatagaaacaaccagaatatctgaccacgtatctgggcaccttgtggcccagtcaagctgacacacaaaattaaccatcacagcagtcattgtgtaataggccccaagaaaaacacatgaggaacactggttactcctaaaacatctacattgaccaagattagaggacagaatctaaattagaagtgcaacttggaggccaggcgcggtggctcatgcctgtaatcccagtattttgagaggaggaggcgggcggatcacctgaggccaggagttcgagaccagtctggccaacatggcaaaaccccatctctattaaaatacaaaagaattagctaggcgtggtaatgcgtgcctgtagtcccagctactcaggaggctgagggacgagaattgctcg

SEQ ID NO: 93103 - DNA, 391 bp, Homo sapiens
gttgcttgagctgtggataccagtagatgcctgggcctgagctgctctatctgctcagtcatccatgtagccagagttcctgtgcagagtctggggtgcagaggctgggatgtgctgtcagcctagcaactcacgaggcatatccccacataggctggaaaacatggtgttagccccacagcctttaaatgccgtctttggaaattgctgcagctggtgtctggggccctctcctgggggctgctgcgccatggcaggctcaccaaggaccttcctcttcaggagattccattgcttaaacacaatcatcgcttgtcatttttgggactgtccaaagaagagatgtgatttttttttttttaatatagtagaagctggaaattcatacaag

SEQ ID NO: 93104 - DNA, 282 bp, Homo sapiens
cagcctgcaggtccacatgttcactgtcttggttgtttgctccttttgaatttgccttctttgatgttcaagagattcctcctagactcagtattctaagacttagtgaacacatctactttttcttaacacattttgtaggtttgggctctgccccaatttccagctgagtcctttataaaaacaaaaacaaagcaaaactgtcttgtagggacccactactccatcctcttgctactttaactgcttatcttctggctacttccaaattcatcacgtttt

SEQ ID NO: 93105 - DNA, 381 bp, Homo sapiens
tcccagattcaagcaattcttctgcctcagcctcccaagttccaatatgttttatacacatgtactcggaggcccccagaggttacgagactgacccaagggcacatttagaccaaatctcagagcaggactagaacctgttctctggagtctgacaaatattgttttactcataacatattgtattgaacatgtacaatctccaaaggcatttttccatgtcaaagatgaaacagggatgtaaaataaagaatgagtatatatgaagtatttatcattttaaaaaattcatttgtttttgcaattttcaagtcataattattttcatgcacagaagctgttttaagcaggacagatacagagagcaccataaaatttcat

SEQ ID NO: 93106 - DNA, 167 bp, Homo sapiens
ttctggttcctacagggcaccctctcactgtgttctcatatggaggaagggatgagctagctttctggggtgtcctttataagggactagaaaaggccccacctcctaataccatcaccttgggggatagaacttcatcatataaattttgaaagaacacaaccatt

SEQ ID NO: 93107 - DNA, 381 bp, Homo sapiens
  misc_feature (290)..(291): n is a, c, g, or t
  misc_feature (298)..(298): n is a, c, g, or t
gaggaccagaaggcagcccgagcccacaagaaaggccgcatagaggaggctaattttagctgggattgaaggatgcataggagctaatattaactcaagagaaacagtttaaaaatcccacaacacctttcaagtaaataacaaattttccatgactctctgctacaatttctggcaggtggctcatagaaataatttgttgcctttcctgggacccagagcaaatagactgggtgtgttccacctttcctgagtagatccaagtgaagtgtcccaaagtgctgggattnnaggcgtnacactgcacctggcctctgttgcagtcttatcttcatttcctttgtttataatgaagtggcgattaggcagttagtttccata

SEQ ID NO: 93108 - DNA, 1114 bp, Homo sapiens
gggagcggaggtgggggcggcgctggaacagaggaggaaagttttgccttttctgtctgggagattccctttctgcacaaacaatcttgccatgtcctgggacgtcttaaagtgagagtaggggttcccccttcactgcagccaggaaacgtgtgaaggcgttttgcgatcccaccccctcacacacacactttcttagaagggaaagctgtgagctctccgggcagttctgcttcttcctgtctttccatggcttggactttcacagatgtagcactgactatccagttgacatgaagacccctttaggagacccacactctgctgctatcccaagaatacgtctcccgaagcccccgctttccagctatcaaaggagagcgatacagtgattccccccaacaacccacaactgacgtcatcgcatgctatttttcctttttttttttcctccgggaagaagaaggagactgaactcattcacttttaactcgcaagccctatttgcccagaggagggtctaatttggaacagaggaaacgttatccataataataatgacgatggtgataatttagagctgtagtatgttgacttctctttccaaacatgtgaaaaagcaaagagactgctgcttggaggtgatttttttttttttttaatctgtaggtctggtttttcctagtctttacctagtaccagtgatttggaaggcattccctggagagaggagagcacagggttatgcaggcatcatcagtgaaagggtagtgaatgcattttaactatgtaagtgtgtctacataaatacgtgtgtgtgtgtgtatatatatatatacatgtatatatatgtgtgtatatatatatgtgtatatatatatatgtatatatatatatataacacctgggattccacaggagactgctttataaatgtctataattcagacaaggagcctctcttcacacacattctcttgagcactcattcactctctcacacaaagattgttgcagtaaaatactttaattggatggggggcgttaggttattattgcttgtataaaatgcctggtccattttatgtgtagaaataacattcctctcaaaacg

SEQ ID NO: 93109 - DNA, 106 bp, Homo sapiens
gaacagcaaggaacttgttaccagtggtaaaatgctgaccactctcatacgtacacgatatcagattggcagggccgaaaccacttcactgtcacctgttttgatc

SEQ ID NO: 93110 - DNA, 375 bp, Homo sapiens
taaatctcctcaaatattttacagagtttcactcttttcatccacagaggaaacatacccccaggcttggaagaaggaaagaactgcatccagattgggctataggtacagttacttcctacagaaatgcgtctttcctatggcttcttaaaactaagaaaaatattcagttatgagaaaagaaaagaacttttatctgaggaacacaagtccttttaattattgggcccagagaggtattaaaaacaggcagcaattgttgcagaattttgctccttagttcagttgtaagtgggttcttttcacacaaccaggaaatttaggcacgcagacacattaaagggtgagtagagcaggattttattgggtgaaaag

SEQ ID NO: 93111 - DNA, 696 bp, Homo sapiens
cacaatgtatcaaaaaggtgttattctgtgacatcaacaactgaaatgggtgggaacagagctgtaaaggaacatagttttgtatgctgttgaagttaagctggtataaattaaaattagagtattaaaactttagaatgttaaatgcgatgtccattgtaagcacaaggagaatagctacagcatctacacaaaaggaaatgaaaaggtaatttaaatgtttcactgcaaagaatcaactcaacacaaagaagacaatattcagaaaatgagacaaaaaagctgtaaggcatatgagaaataacaaaatgacagaagtaaatccctccatatcggtcattattttcgatgaatattaattaaaccctcccatccaaagacacagattggtagaataaacaaaaagatatgatcccattctatgctatctacaatagattcgctttgaacccaaagatacaagtggattgaaagggaaaggatggaaaaaggtattccatgcaaagagtaacccaaagacagcaggagcggctctactaatatcaaagaaaataagactttgaattaaaaaggttatgaaacaaagaaaaatattacatattgataaaaggttcaacagagcaagaacatataactattataaacatttaggcagctcataacagataatcaacatatacaaagcagatattgata

SEQ ID NO: 93112 - DNA, 369 bp, Homo sapiens
aggtaaaactacgaactgggagcccaatatgtggtctacctaaccatggtgaattttacataacatttcctttggctttgttatttataaaccttaactattaaaatacgggctgagatgtcaacatcacagctatcagcactcaacatttcttttctcaagacaattaaaaatccacatttccttgtttagcataaactttctagaaaggctctttgtttttctgccccattttatctaaaacaaatagcacaaatcagaggaaaagagtcttttctaacatttgttcaatctaaaagctaaatccagcatgtaggatatacttactttattgctataccatgattggctctcttcttcactccagga

SEQ ID NO: 93113 - DNA, 1030 bp, Homo sapiens
cagaaaaaagcctaattgcaacttgatggctttgttggctttctgagcaatgtgtccagttgccacagtgaagggaatggaataatctaactcaccattcccaagtcctatgccatcctgagagtggggggtggagtcaattcaccttggtgcttggactaagcatgaggtggtgagtgacaacgttcctaattgaagggtagggtaaatggttgttgggtggacaccaacacttattctactacagaagctaaattgaaccctcaggcagggtacgtgaaagtggcaagagatgtcaagaccactgggcaagttggccagttgttccttaggaatgaaaattcttttgaaaggaatggccagggtcctctgctggccccacttggtcttctggaggctctgatcttggttggttagtggtctttacaggccaaggtcaaggccattgcacaaaaaaccctgtgcatgcccttaacttgctttcagttgaatatttgggctgaactatgaggcagagaggaatcccattgggtggctccttgctgcattcgcagttgaccagcatggggtttgttggagaaataggaaccatcccctgaaaacacacactatggtagccactcaactgttgaaaggcactggagtccaatgggtgaggccgcctctgagacaagcctctgagttgaggctgggagaggctccctccttggagtgttgctttttttgtttcacccctgcctctggagatgggtagaggaacatgagctgaccttctgggaagttaggttggtgaggagttgctgaggcactgcagggccatgcccagtagagaggaatgtataacattttaagaggctgagagcaccccttgttgggcgcatgcccaatggcagcttccttctgccgatcatgggagaaatcaagcactttcacctaatggctagatgattgattttgggatgaaattctccactcctctcctttaccacatcaccactatccttcctgcaatacatccacgagactcact

SEQ ID NO: 93114 - DNA, 384 bp, Homo sapiens
acagcgaaatctaaagcaggtcatgtcagtccctggcagggaaccctccaccagcttcccgtgttccccaggacaaaagccccactcctcactgtggctccacagccctgtgtccagggcccctgccagtgtccagcttcctcctgggaacttgccctcatctcatgactacctctgccccagtcacagttgcttttctcttttcccaaacatcaaaacccttcctgtctcaggttattgtccctgctcttacactatgtacctaaatgatgacagcactgtccctttctcctccttcaggtctaggctcagagatgtctcccatgccctcccacccccatctgaagattcctctgcctgtcagtctctcacgttactcaggaa

SEQ ID NO: 93115 - DNA, 335 bp, Homo sapiens
tgatgatcacggatgaggtcaaggtgagctcagggcccagggctgggggccccccagggccagccctcttggatcttcggatggggtcaaggtgagctcagggcccagggctgggggccccccagggccagccctcttggatcttcggatggggtcaaggtgagctcagggcccagggccgggggccccccagggccagccctcttggatcttcggatggggtcaaggtgagctcagggcccagggctgggggccccccagggccagccctcttggatcttcggatggggtcaaggtgagctcagggcccagggccgggggccccccagggccag

SEQ ID NO: 93116 - DNA, 366 bp, Homo sapiens
ggggctcatcttaccttctgaaaccttcatacaagccacttaacagacgcctctctacctcttagagacattccgcaatgcaacaagcagcttgagttcttttcactcagagattcactcctcatttcataatattctgagccccaggagacatcatagcatcaaatcaaaactccccaggtctttgagccttgctcttaaaggaagatcatgagtcccaccaggcagttcttccttctactacataatcaaactccttttctctaaaatgtactgagtttggaacctacatgcgacttgtgccctttgatttgttgcccagattagtttgtgctgggctctatcctatcaccaggaatggtggtt

SEQ ID NO: 93117 - DNA, 498 bp, Homo sapiens
gataatgagaatagttttgatctgaaagtaaatgacttgacctcgtgatccacccgccttggcttcccaaagtgctgggattacaggcgtgagccaccgcacccggcctaaagtcacaaaatttattagcatcaagttattaataacatttccttattaaccattttaaatatctgtaggatctttaacaacgtctctttctttttgatactggtcatttgtgttcaataattgcgtcctctttttttcttggttggtgtacctagagtttagcaatcatattgaccttttcaaagaaccaccttctggcctcattagttgtgtctattgtttatccagctcataatggattacaaacctaaatttcaacttaactataaaccttctagaagaaaacaaagcagaaaatttttgcaactgtaggttaggcagaagatttcttaggtggacactaaataacacaattcataagagaaaaaaattggtaaattggacttc

SEQ ID NO: 93118 - DNA, 230 bp, Homo sapiens
tcctgccctcccccaaaaagacctgttgtaaacactgttcaaacaccagcattttattaaggataaagtaaccagaatttacttttacaacaagaagtggaacaccattactgacagtaaatacttgctttcatttatctcagtcttggcatcaaactctgaaataaaatttaccggccgggcatggtggctcacacctgtcccagcactttgggaggccaaggcaggcg

SEQ ID NO: 93119 - DNA, 442 bp, Homo sapiens
acagcattgaaaaatgactattttactttgtctaaaaaagtctttcaacaagggtctcaatagtttttgaattcattggtttaatttcttttgataagtttgcaagaacaactgatagacattaagatagctgtgatgcattagtaaattttaataaaatcttttcttatgaaattggccaatgggatttaaaagcttggtcatggttttctaagtgtagccccaaatgcacttctatgtggattcacatagctttgttagctttcttacgtagttgtaaccctcattaattccaagttttgggagaaaaaaaatcctgaatttcaaacctgttcttggaatcactggtttataaaatatagactgggttgaaaaataacgaagcatgacctattatgttggttttactacattttttcttacaattaataaataagataaa

SEQ ID NO: 93120 - DNA, 458 bp, Homo sapiens
acagagcagtgctatcatatgctatgctttgtgtaaaaggatcatatgttaggaatttacgctggcataaagaaagaagactatgcttgtatttccataaggaaacactgaaaaggatacacaagagactaatgaaatctgttccctgtgccccagggaagaactgggtgaagcgtggtttggggtgggaaggagacttcactgtctgccatacagacatatatacaagctttttcatatatatatgaagatgtatatttaaacttattttttaaccgggtgaataatttgcctatgaaaagcccagaaagagaaaaccctccatgacccacggcccaaggcccagaggtaccctggcccagctgcctctgcagcctcatcctgggaccctctcctccctcctctttctgtgcccaggaaggcacagctccagccttctgcctccatgaccctgccac

SEQ ID NO: 93121 - DNA, 405 bp, Homo sapiens
ctctaacatgctagtttatttcgtagtgtaaaatgtgtgttactgatgggcagacagctctcattcaagcagtgacagatgtaagctcttcccatttttgtggccccattgtattcggcgtgtggcttccaagttgcctgggatcatctccacccagactaaggaagaggaaagagcttggacaactgcacttggctggtttttatggatcaggcaaggaattggctccaacacattagctcacattccattggttagaactgggtttctcaactattagtacagggtgagtgtagggttttggcaccatgggcatttgagctggccaaaggctaatcagagttagaacaaagccacaaagcctgtgaatggtgtttattgttgtgaggagctgtcttgtgcatt

SEQ ID NO: 93122 - DNA, 665 bp, Homo sapiens
atgatgtcgggggacacaggcagctcatgcctggatcaggcagtgactggtgtgtgtgtgtgtgttatgaagagagagggatggaaattgtgaccagagagttggagttgggacccctgtcttgatcacttgagcatcagcagctccagggaagaacacattctgaaggaggaactctccagctaggatttcatcctgtcctagaggacacgaagaggtggagaccacccccacaactaaacttgaggattactaaggcaatggggactgcctaggaatatttttgagggggtaaaagcaccccataattgtgctaagtaacaaaagacagaacaagcagccttaaaacattctacatgatacactggtattagaataataagatcttaaagaccatccacttgaaaactggatttgcccctggtcatatgggcagacccatggcagacaaagaactagaagttcctcctaactcccaactcaatgtcctttccttaaagaataactgttctttattataaataggccaagcttttattatttagtatagaactcaggctgatatttttattgatggattaaaatttgaattattctgtagcatagtatttaaaagttttcttctacatatttgttatcattttctagcaaatatcctcaaaatt

SEQ ID NO: 93123 - DNA, 311 bp, Homo sapiens
tgtcaatgctacagtctcaaaagaaagagcacacttagggctcaacttagtgccttgtgtaaagagaaaagaaatgctttataagcagcgtggtgattcctcaaagagctagacacagagctaccattccacctagcaatccttttcaggaacatggatggagctggagtccattatccttagcaaattaactcaggaacagaaaaccaaatactgcatcttctcacttataagtgggagctaaataatgagaactcatggacacaaacagggaaacaacaggtactggagcccacttgagggtagagagt

SEQ ID NO: 93124 - DNA, 211 bp, Homo sapiens
cagtaagcttagtcaaatacacagaaatataaaaatggtatgagtttgctctttaactgtgctatcggtacacaagaatccctaaagaaagaacttcagcaaactcttcctatcctttcctgaatgtgttagctcaatttctaataagcactctatgtctttatagaacctttaaaataacaactttctttttaataacaaataacatttt

SEQ ID NO: 93125 - DNA, 138 bp, Homo sapiens
ataatcagataataacttttaacaggaaataaaaataacattgctaaaattaaaaagttaatagaagtgtaggaagataaagtggagaaattctatcagaaaacataaaaagataaaaatatacaaaatttgtagcat

SEQ ID NO: 93126 - DNA, 335 bp, Homo sapiens
tcaacatcaccaagtgtcatgcagggtcacacagtcacaaacagcactcaatatcacatcactcaatgtcactgtcatatagtatacatcaatgtcacacattgcatatcattgtcacacgtcactcaatgtcacacgtcattgtcagtgtcaatgtcatacagtaccatacatccctcatcgtcacacaatgtcacacattgtcacaaatcgatttcacacaatgtcagtgtcacaacactgtgtcacacaatgtcattcagttcatacatcggtgtcacagtgtcactcaatgtcatacagttcacacattgttcattgtcacaatatcacat

SEQ ID NO: 93127 - DNA, 516 bp, Homo sapiens
agggttagacggtaccaacagctcaagggctcagtctcacaagactgttccctacttcagatgccagttccaagtcttgggtgccagggcacccacacttctgtccaacttggctaccaaccagggggttcccatggccccctcctcaggttcaataatgttataaaggctcacaggactcagggaaacgttacttatgtaaaggatacaaatcaacagcaacatgaagaggtacacagggccatgtctggaatgtccccactgcaggagcttctgttcccctggaatttggagggtaccaccctacccatacatggatgcattcaccaacctggaagctctctgaactctccccatactccagccatcagttagggtttgtatagagattccattatgagggcatgactgattgctgattaaactcaatcttcagcccctttccaatctccagaggtcaaagggtgggactgaaagttccaaatttctaattatggcttggtctttttggtgact

SEQ ID NO: 93128 - DNA, 467 bp, Homo sapiens
cttgccccagcctcccaagtagctgtgactacaggtgcaaaccatcacacctggctaattaagaaaaaaaaaaaaagtctttttgtacaggcacagtctcgctatgttgcccaggctgggtcttgagctcctgggctcaagtgatcctcctgcctcagcctcccaaagtgctgggattataggcgtgaaccactgtgcccaacccatattttgatatttaatgctaacgtattttgagttttccatttgttctgatttgtcctttttaattccctcataacttttttggaggggctaatttatcaagttttaaaaataatgtcataaagttatatcctctatttctgttagtgattacccccataccttccatttctattattttaataattgccttaaattttcagcatgcatatctacattaatagaatctaaaaattattaactctgcccaccttcttactata

SEQ ID NO: 93129 - DNA, 387 bp, Homo sapiens
gatccttgctagggagagtaattcaacattgcaactaagcgttttttttttctttttaagatatattaagtccagataggcggactcctgttattctgtctactgcaacttcagcacgttgcccatgtaaaattattcccccaaagaatgttttatgaagggccaagggtcatgtcactcattagagaaacttcgctcatcaactatttgtcaccagttttttgacactagaaatattaaattcagatgaacttgaaaagtgacttaaaagcctattgcccaaaatattattctaggaggctatatcttatgatcaagccattaaaaggatttgaccaagacaaaaatgttcagcaattgaagctcctataaatgggttgtgtgtga

SEQ ID NO: 93130 - DNA, 802 bp, Homo sapiens
gctgggctatctgtcctgttccattggtttaaggtgtctgcttttatgctattatcatgctgtttgattataacagctttactttatacagccatgttccacataacaatatctcagtcaacgacagactacatgtaaacagtggtcccataagattataatggagctgaaaaactcctatcatctagtgatgttatgttatagtgcaacatactactcgtgttcgtggttatgctggtataaactaacctcctattcagtcatataaaaacagcacataccattatgtacactacagtatataattgataatggtaataaacaactattactggcataagctggtatataaccagcttataaacaactattactggcatattactggtatttactatgattctgaccctgtgtaggcctaggctaatgtgtatgtttgtgtcttagtttttaacaaaggtttaaggggtaaaaaataattttaataatagaaaaagcatgtagaataaagatatcaaaaaagaggccggggcatggtggctcacacctgtaatcccagcactttgggaaaccgagacaggtggaccacttgaggtcaggagttcgagaccagcctaggcaacacgatgaaactccgtctttgctacaaatgcaaaaaattacccgggtgtggtggcacatgcctgtaatcccagctagtctggaggctgaggtaggaagattgcttgaacccgggaggtgggggttgcagtgaaccaaggttgcaccactgcactccagcctgggtgacagagcaagactt

SEQ ID NO: 93131 - DNA, 578 bp, Homo sapiens
gggtggaatgcgcctgccacccccaggctagacgagggggcagagggtcagggtgggcattcgttgtgccgcttttgagctttgtgggccagagctgggtgtagggctggacaatgagcctcctcttccttgaaagaaggaattttggctgagacaatagggccctgtctgttctggcatggggggtggtggctgactcaattctgttccccctaagccctaacaaatgtcatgaagagaggggggcagttttccccttggtgccctgggctgcccccctgcccctttgtgacgacttgcccttctagctttcctcagctgatcttgctttttctcccataacctgaactgctttgttccctgcagctggttctctccctgccccctaactctcccctagtctgttttgggttcaagggggtactggtggtgttacagagctcatagcttctgatctggggagtccagaaataggggcctcagagggttggaaagatacttctagggagccctttgctgggatggggatgagggtagtgggacttgaccctactgagctgaccctgctggagctaagg

SEQ ID NO: 93132 - DNA, 403 bp, Homo sapiens
ccactgtactccagcctgggcgacagagtgggactccatctcaaataataataataatatccatcctaacaggtgtgaggagatacctcattgtggttttgatttgcactgcctggtggttagtgatgtgtactttttcatgcacctattgtatgtctcgtttctcttttcaaaccattgctgcttccctgcttaggcacacacaggtgctggggacatgtgggatctcaaaccacctaattcactttggagatgggtgtaggctgcagcagctgcaggctaccctgtgaacgcacagagctctgcagccgcaaacgggctggcctcctcactggccttggcctgacatgtgatgctctgagggactccacctgcaggagcctccacagtgagtgcctgcttt

SEQ ID NO: 93133 - DNA, 189 bp, Homo sapiens
tgatatgttttctctaggtcttctatttcttttctttccatttcactgccacaggcatgccacttaccatcagcattccatagatattttgtactcctattctgtatatagaactaccaaattattccgatagctgcctgagaccataaatatcatattgggtcagattaataattcggattcaagaac

SEQ ID NO: 93134 - DNA, 394 bp, Homo sapiens
ttctgactgtctgtctcggttctttgtttctcggcatggcaacagttgtggatgctgcctgcgtggccagggctcctagtagcactgacctgcaagatgagtgctggaagccccaacacaattgtttgggaataaatggaagtgaggaatggagaagtaaggaggtaccactctcaaggaggctgtcagtagaggggacaaagagtgtgagagaggaacagaagaaccaagcaggagactggaagagggatttacaaatctggagtccttccaaaacaggacaagtaagacatgagcagtgactttctactctccatccagcagccaacaatagacttcgtcattcagatggagctgcagaggtacagacctgagagagctggaagtcatagag

SEQ ID NO: 93135 - DNA, 134 bp, Homo sapiens
cagtggtgggcagagactaggaaggaagggctgcgtcttctcttctctttctctcttccatttccctcttctctcctctcccctcccctctcaacaaatataaaggttgtcttgatgaagtataaaggttgccc

SEQ ID NO: 93136 - DNA, 294 bp, Homo sapiens
ttttgctaacacccagttctgcctgctacaccacctgggaattgaccatccagctgtgttctctctgcctctggcccagtagcaactgacctgccctattcctggctgatctcatgctgctgaagttcaaggcgctggacacactaccctgatttttgttgcacctggcctagcctcattaacttggcaattagttggtggttttctttctttcttcttctttttttttttttaattcatttcatttctgtcaccccttaattttcatctttcttttttaagtagttgttccat

SEQ ID NO: 93137 - DNA, 717 bp, Homo sapiens
ggaaaacaatttgtgtgagtattggagttgcacactgaattagacacttttttcatgcaataccatattttcttgaaaaaacactgactggcaaagtatggttatccagatatgggtactggtggacatttcactttgtattccagtcacttgaaggaaaataacagacagtgtttgttgccagttgtgtcataatttttttttttttgagatagagtttctgtattgtcacaaaggctggagtgcaatggtgtgatctcggctcactgcagcctccacctcccgggttcaagcgattctcctgcctcagtcttgtgagtagctgggattacaggggtgcaccaccatgcccagctaatttttgtatttttagaagagacagggttttgccatgttggccaggctggtcttgaactcctggcctcaagggatccgtccacctcggtctcccaaagtgctgagattacagacatgagccaccgtgcccagccattgtgtcataattttatacatactctatttcatataaaatctcattagttgatattgaatgcattttattgtgtctaagatttttcattattaagctaggtatctctaaacttttttctgacacattttctttttcaccttcagtttcttgccagctctgagtatatgttttagtcagaagcctttctattgcaggtgcaaaaccctaatttaaattagcttaag

SEQ ID NO: 93138 - DNA, 266 bp, Homo sapiens
cacacacagtattttaaaaagtaaaaaacgaaagtaataaataaacaagaacttggctgggtgcggtgcctcatgcctgtaatcccagcactttgggaggccgaggcgggtggatcatgaggtcaagagattgagaccatcctggccaacatggtgaaaccccgtctctactaaaaatacaaaaattagctgggcgtggtggcatgcacctgtagtcccagctactttggaggctgaggcaggagaatcgcttgaatgtgggaggc

SEQ ID NO: 93139 - DNA, 99 bp, Homo sapiens
tcctcagcaccagggaaatgggattaaactggaggaggttaagagatggttaacaaaaatgctaggagtggagaaagttagatttaaacaagcaagatc

SEQ ID NO: 93140 - DNA, 341 bp, Homo sapiens
cagactgaagctgggtctccaacagtgatggcctgggagaatcactacacacgtgtgtttggacagcactttctacttcttaaaaagaagatatccacatctatcgtgaaagctgagaaatctaagagctggaagcctgggaggaagggatgtgctgtggccaacacaggagggcagaaatgacccctctgtgaccgctcctgtagccagaaagagccacaaacagtccaactccaaaggggaaatggtccccatttcctgcaggtaaccttctcatgacctgctctactccctggaaattcttgacactaaaggacactaaagaccttcttccttagtgc

SEQ ID NO: 93141 - DNA, 391 bp, Homo sapiens
ccaatcccatgtattactgacgaggtaactatggctcagggtgacttgacctgtaagccacaagcttgtgggtgaccactccaggccctgaatggaggatttcactccatccccctgccccacaagtggcctctgagagacagagtacctgatgccaccttatgtgggatattgtttttgctgtcacgaatttctgaatcccctctttgtggaatagagaaatcaaagccaccatacgttcaagggtatccactaaagaagccacatggttacttcagctaaaaataaattaaagacctaacaatgaattatcatttatctaatcatctgggaatgatgaaattaatgtttcgtatctactattttacagttataaattgcttagaaagta

SEQ ID NO: 93142 - DNA, 6226 bp, Homo sapiens
gtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagggcggtccctctcctgggctacctacctcaggacctgattgaaaccccagtgctcgtgcagctccaccctagtgacaggcccttgatgctggccatccacaaaaagatcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcagcccgtcccccacagcggctccagtggctacgggagtctgggcagcaacgggtcccacgagcaccttatgagccagacctcctccagcgacagcaacggccatgaggactcacgccggaggagagccgaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcagtgtatattccaaagatggttcagaaaatttaatattggtccctggtggaaattcaaagttatcactgaagaacagttgacttaaaattggaccaagactatgaggcttaaaagggaccagggttttctttttttttttttttttttttttttttagatggagtttctttttgcccaggctggagtgcagtggcgccatcttggctcactgcaacctctgcctcccaggttcaagcgattctcctgcctcagcctcctgagtagctgggaccacaggcgactgccaccacacccagctaattttttgtatttttagtagagacagggtttcaccatgttggccaggctggtctcgaactcctgacctcaagcgatccacccacctcggcctcccaaagtgctgggattacaggcgtgagccaccacgcccaactgggaccagggttttctgttttttgatggaggtgaaatctctttgtaatccactaggttttcatcgtaaaaccatcttatgcctgactattaaacctattcttcataaacacaagaacactttaatttttcgttaatttacaaagtaacatcagctgcctatgcctatgataaggtagcagtctgcattcttatggccattagatgttacaaactccttgcctctaaagtcagatcatgaagggataggtgttcatctaaggttacagttatgttaccgaaacacaaaactgccaaaatcttactctgctgttatgaatgtttaccatcagcattattttatcatttaatatgtgctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaatagatttgtttgactgcttgtgtctttttatgacctgtttgccttttagaaaattggtaaataaagcaagtatatttttattttta

SEQ ID NO: 93143 - DNA, 423 bp, Homo sapiens
gccctggctgtgtctgtagcgctgtctgctgtctccccagcccgtcccccacagcggctccagtggctacgggagtctgggcagcaacgggtcccacgagcaccttatgagccagacctcctccagcgacagcaacggccatgaggactcacgccggaggagagccgtacgtctccttccattctccctgagaaaatgagtttgtggatgtccctccagagttaaaaagcacactcaagacaacctttggcagttaggaggggcttcctgattgcagctgttgctgcttcctttctaaactttgtccacttgggactttttaatctcttaagagttgaaagagctagaaaccatagctaagtgttggttgaaaattatttaaaacagacaaaacaagcaaaagtgaagatttaactaggatag

SEQ ID NO: 93144 - DNA, 6270 bp, Homo sapiens
gtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcagcccgtcccccacagcggctccagtggctacgggagtctgggcagcaacgggtcccacgagcaccttatgagccagacctcctccagcgacagcaacggccatgaggactcacgccggaggagagccgaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcagtgtatattccaaagatggttcagaaaatttaatattggtccctggtggaaattcaaagttatcactgaagaacagttgacttaaaattggaccaagactatgaggcttaaaagggaccagggttttctttttttttttttttttttttttttttagatggagtttctttttgcccaggctggagtgcagtggcgccatcttggctcactgcaacctctgcctcccaggttcaagcgattctcctgcctcagcctcctgagtagctgggaccacaggcgactgccaccacacccagctaattttttgtatttttagtagagacagggtttcaccatgttggccaggctggtctcgaactcctgacctcaagcgatccacccacctcggcctcccaaagtgctgggattacaggcgtgagccaccacgcccaactgggaccagggttttctgttttttgatggaggtgaaatctctttgtaatccactaggttttcatcgtaaaaccatcttatgcctgactattaaacctattcttcataaacacaagaacactttaatttttcgttaatttacaaagtaacatcagctgcctatgcctatgataaggtagcagtctgcattcttatggccattagatgttacaaactccttgcctctaaagtcagatcatgaagggataggtgttcatctaaggttacagttatgttaccgaaacacaaaactgccaaaatcttactctgctgttatgaatgtttaccatcagcattattttatcatttaatatgtgctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaatagatttgtttgactgcttgtgtctttttatgacctgtttgccttttagaaaattggtaaataaagcaagtatatttttatttttaaaaacaacaaaaacaccaacaccaacacaaatttgttggggcggccttgggccctggaaaagttttttaaacccatccgttgggcgcgggggcccgggggtcgtgacaccggggcagcgggtcccgagggaacccggccgagacagggtgg

SEQ ID NO: 93145 - DNA, 4987 bp, Homo sapiens
  misc_feature (4966)..(4966): n is a, c, g, or t
gtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcagcccgtcccccacagcggctccagtggctacgggagtctgggcagcaacgggtcccacgagcaccttatgagccagacctcctccagcgacagcaacggccatgaggactcacgccggaggagagccgaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcagtgtgcntccgggatcctctagacgcta

SEQ ID NO: 93146 - DNA, 4954 bp, Homo sapiens
gtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcagcccgtcccccacagcggctccagtggctacgggagtctgggcagcaacgggtcccacgagcaccttatgagccagacctcctccagcgacagcaacggccatgaggactcacgccggaggagagccgaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagcctggtttgcaaagggaagtcaccataaagagatgactgatgacatattttaatctccatattggccatcatggtctgaaaaggagacaagaataatgcagaaatatacagagggtctgttgcagtgtgcttccg

SEQ ID NO: 93147 - DNA, 5003 bp, Homo sapiens
atcacctaaggtcaggagttcaagaacagcctgggcaaggtggtgaaaccccgtctctactaaaaatacaaaaattgccttgcatggtggcgcgcccctgtaatcccagctactcgggaggctgaggcaggagaatggcttgaacccgggaggcagaggttgcagagagacaagattgcgccactgcactccagcctgggtgacagagcaagactctgtcttaaaaaaaaaaaaatgtaatgtgccgttttgctttattttttattattctttaggatcatcaaataggttttatctagctctacacctgtcagatttctcatccacagtttccttctgtgttgctgaaattatttcagccatcctctgttctcactttgccggacagactgaaggaggtctcctagaatgaataatgtgttcattttgtttttcttcaaggaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcagtgtatattccaaagatggttcagaaaatttaatattggtccctggtggaaattcaaagttatcactgaagaacagttgacttaaaattggaccaagactatgaggcttaaaagggaccagggttttctttttttttttttttttttttttttttagatggagtttctttttgcccaggctggagtgcagtggcgccatcttggctcactgcaacctctgcctcccaggttcaagcgattctcctgcctcagcctcctgagtagctgggaccacaggcgactgccaccacacccagctaattttttgtatttttagtagagacagggtttcaccatgttggccaggctggtctcgaactcctgacctcaagcgatccacccacctcggcctcccaaagtgctgggattacaggcgtgagccaccacgcccaactgggaccagggttttctgttttttgatggaggtgaaatctctttgtaatccactaggttttcatcgtaaaaccatcttatgcctgactattaaacctattcttcataaacacaagaacactttaatttttcgttaatttacaaagtaacatcagctgcctatgcctatgataaggtagcagtctgcattcttatggccattagatgttacaaactccttgcctctaaagtcagatcatgaagggataggtgttcatctaaggttacagttatgttaccgaaacacaaaactgccaaaatcttactctgctgttatgaatgtttaccatcagcattattttatcatttaatatgtgctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaatagatttgtttgactgcttgtgtctttttatgacctgtttgccttttagaaaattggtaaataaagcaagtatatttttattttta

SEQ ID NO: 93148 - DNA, 2948 bp, Homo sapiens
gctcttaaaaggaagaggtgacgaggctcaaattgaaaaacgtattcaagaaatcattgagcagttagatgtcacaactagtgaatatgaaaaggaaaaactgaatgcacggcttgcaaaactttcagatggagtggcatcgataaacaccggtgtttatcgatgccaccagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcagtgtatattccaaagatggttcagaaaatttaatattggtccctggtggaaattcaaagttatcactgaagaacagttgacttaaaattggaccaagactatgaggcttaaaagggaccagggttttctttttttttttttttttttttttttttagatggagtttctttttgcccaggctggagtgcagtggcgccatcttggctcactgcaacctctgcctcccaggttcaagcgattctcctgcctcagcctcctgagtagctgggaccacaggcgactgccaccacacccagctaattttttgtatttttagtagagacagggtttcaccatgttggccaggctggtctcgaactcctgacctcaagcgatccacccacctcggcctcccaaagtgctgggattacaggcgtgagccaccacgcccaactgggaccagggttttctgttttttgatggaggtgaaatctctttgtaatccactaggttttcatcgtaaaaccatcttatgcctgactattaaacctattcttcataaacacaagaacactttaatttttcgttaatttacaaagtaacatcagctgcctatgcctatgataaggtagcagtctgcattcttatggccattagatgttacaaactccttgcctctaaagtcagatcatgaagggataggtgttcatctaaggttacagttatgttaccgaaacacaaaactgccaaaatcttactctgctgttatgaatgtttaccatcagcattattttatcatttaatatgtgctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaatagatttgtttgactgcttgtgtctttttatgacctgtttgccttttagaaaattggtaaataaagcaagtatatttttattttta

SEQ ID NO: 93149 - DNA, 416 bp, Homo sapiens
atgacagctttttagtgtatttatttaacaaatagaactttgtattaccacttatcatattagcatttcataaaagaaaggacatttaataccagaagaaaataaggaatgtgtcctgcaattaagagcttgtaatttaagttgattcaatttagttttatggaaaaacctgatgttttgccctgatttttctcacttcactgaggatcagggaaaaccgctcggtggaccaggcaggccctgggccagcatttggaaacccaggactgttgaacgaagaggtgtcttcaaatttggagttaaaattttaactccgagtatttgtttttctgcattagctgcccctggactaagaaatacttccggaatagattcaccttggaaaaaaacaggaaagaacagaaaattgaagtcca

SEQ ID NO: 93150 - DNA, 6119 bp, Homo sapiens
gtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcagcccgtcccccacagcggctccagtggctacgggagtctgggcagcaacgggtcccacgagcaccttatgagccagacctcctccagcgacagcaacggccatgaggactcacgccggaggagagccgaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcagtgtatattccaaagatggttcagaaaatttaatattggtccctggtggaaattcaaagttatcactgaagaacagttgacttaaaattggaccaagactatgaggcttaaaagggaccagggttttctttttttttttttttttttttttttttagatggagtttctttttgcccaggctggagtgcagtggcgccatcttggctcactgcaacctctgcctcccaggttcaagcgattctcctgcctcagcctcctgagtagctgggaccacaggcgactgccaccacacccagctaattttttgtatttttagtagagacagggtttcaccatgttggccaggctggtctcgaactcctgacctcaagcgatccacccacctcggcctcccaaagtgctgggattacaggcgtgagccaccacgcccaactgggaccagggttttctgttttttgatggaggtgaaatctctttgtaatccactaggttttcatcgtaaaaccatcttatgcctgactattaaacctattcttcataaacacaagaacactttaatttttcgttaatttacaaagtaacatcagctgcctatgcctatgataaggtagcagtctgcattcttatggccattagatgttacaaactccttgcctctaaagtcagatcatgaagggataggtgttcatctaaggttacagttatgttaccgaaacacaaaactgccaaaatcttactctgctgttatgaatgtttaccatcagcattattttatcatttaatatgtgctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaatagatttgtttgactgcttgtgtctttttatgacctgtttgccttttagaaaattggtaaataaagcaagtatatttttattttta

SEQ ID NO: 93151 - DNA, 4088 bp, Homo sapiens
  misc_feature (330)..(330): n is a, c, g, or t
  misc_feature (539)..(539): n is a, c, g, or t
  misc_feature (596)..(596): n is a, c, g, or t
  misc_feature (600)..(600): n is a, c, g, or t
  misc_feature (670)..(670): n is a, c, g, or t
tgctagctctccaaactaggacttgctcagcagaggccgccagcccggagctggatccagagcccggccttggggaccccagctcccacctgcgccctgccttccagatcagccaaccgcctgccatggagactttctttaggagacatttccgggggaaggtgccaggccctggagaggggcagcggcggcccagcagcgtggggctgcccacaggcaaggcccggcgtcgctcccccgctgggcaggcctcctcctcactggcacagcggcgccgctccagcgcccagctccagggctgcctcctgagttgcggggtgagggcccagngttccagccgccggcgctccagcactgtgcccccttcctgcaacccccgcttcatcgtggataaggtgctcactccacagcctaccaccgtgggggcccagcttctgggtgcacccctgctgttgaccgggcttgtgggcatgaatgaggaggagggtgtccaggaggatgtggtagccgaggcatcgagcgccatccagccaggcacnaagacaccagggccacccccacctcggggcgcccagccgctgttgcccctaccccgntacntgcgccgagcctcctcccactgctccccgcggatgccgtatatgaccacgctctctggggcctgcacggntactatcggcgcctcagccagcggcggccctcaggccagcaccctggccctgggggccgaagagcctcaggcaccaccgccggcaccatgctgcccacccgtgtgcgcccactgtcccgcaggcgccaggtagccctacggcgcaaggcggccggaccccaggcctggagcgccctgctcgcgaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93152 - DNA, 869 bp, Homo sapiens
  misc_feature (758)..(758): n is a, c, g, or t
  misc_feature (764)..(764): n is a, c, g, or t
  misc_feature (767)..(767): n is a, c, g, or t
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaaggagtgacccagcactcgggggtgaagagtcaaggaccctggagccaaatgcctgcgttcgaatcctggctcctcactgattagctgctgtatccccactgcctggaacaaacctggcgcctagtggataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcatancacagnagngtctgcttcatgcagcagcagatcgaggaagcgggctcgtggggtcccagcaccggtcacccggcaacggtctcgggccggggccagatatttgagcagcag

SEQ ID NO: 93153 - DNA, 461 bp, Homo sapiens
cggccgcacgatggccgaggggcagggcggcggagggcagcgctgggactgggctggcggcggccgggcagccgaggaggaggtggtgcggcggcgatgccggcgcggggaggaggcccaggtcgcgcagccctggcccgagggttcccggggcacggccgctgggcccccggtggaggagcgtttccgccagctgcacctacgaaagcaggtgtcttacaggtaaggaggacgtgggcagaggggagcgcggcgcctgggaccacccctcttgcaggcgtcattgcacaaacgtttattgtgcgcccgccgcctgcctggcgctgggagtttagagatgactgccgagggatctctgtcttttcgtgtacagcgggaaggaggcagcttctgagactccttctctgcctgaaccgtgaaagccgtattcatccaatatgcggtggctgagggaacagtgt

SEQ ID NO: 93154 - DNA, 382 bp, Homo sapiens
gactagccgatggggctcaaagtcgtggcgctcaccatgacgagagggtggtgggaagtgaggccaggcctcttcctcccgcagccagctcgccctgcggagcctcctctgtgctggttccccctactccaagttcccttccctccctggcccccactctatcccagcctggcctttgcttctctcaacaggagcccgatggtgctggagccaagtccccgacatgccagaaactgtcccttccctttcctacctggggtctcagcctcccctctgccctctggccaggggtcactctcacctttgttctctggctagagtttctgcttcggaaggagcagagtctgggacccccctgccctcagccctggtgccatctgac

SEQ ID NO: 93155 - DNA, 3384 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93156 - DNA, 3306 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93157 - DNA, 2665 bp, Homo sapiens
tcaccaacacccctgcttcccttgcagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93158 - DNA, 3477 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgagctccccgcatgggccagccgagcaccagggctgggcctgaagccggggtccctgtgggcctgatttgcctctgttcttcctcccccaggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93159 - DNA, 1767 bp, Homo sapiens
caaccgcgagctgctaactcaggggcgagctgctaactcaggggcgagctgctaactcaggggcgagctgctaactcagggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93160 - DNA, 2600 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatccggtggaggaaaacggggagaccacacctctgtcatgtaccaaatcctgactg

SEQ ID NO: 93161 - DNA, 963 bp, Homo sapiens
ccagacagtctgtgtgaatcggacgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93162 - DNA, 1353 bp, Homo sapiens
ggccctctgtgggatctccagtgatcgtcccattccacttcactgtatctctgtctaggccacaatagatggctcctagtaggggcttcctagctcagtccacctgtccctggtgcttagaaaggagcaggtcagaggaagcactgctccagggcttggtcaccagtgctgccagagagcccacaggctgtggggtgagaggcccctcctccggtgtgctccagagagacccacagaggcaactcaggagtaagatgtgtgagcgcactcgtttcaggcctgtgctggtgtacccggctgtgggccagcgtgtgagctcagggaaggaggggtggccccaggaggtccagccctgccatgcctcctgccctcagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93163 - DNA, 1585 bp, Homo sapiens
ggccctctgtgggatctccagtgatcgtcccattccacttcactgtatctctgtctaggccacaatagatggctcctagtaggggcttcctagctcagtccacctgtccctggtgcttagaaaggagcaggtcagaggaagcactgctccagggcttggtcaccagtgctgccagagagcccacaggctgtggggtgagaggcccctcctccggtgtgctccagagagacccacagaggcaactcaggagtaagatgtgtgagcgcactcgtttcaggcctgtgctggtgtacccggctgtgggccagcgtgtgagctcagggaaggaggggtggccccaggaggtccagccctgccatgcctcctgccctcagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaagtaagtatctgggcagtgcagaaccgtggtcaccccggaaaccacccttttccccacccctcccattttgtcaggtcagagcccataaacttcctggtcacatctgtcatcccctgggccacccctattgccccagagccctgaacttcctgccctttctgatggcccttgggagacagatgggtggatcaggggacgggatggggtacacagccagcccctgctcccccagcggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93164 - DNA, 802 bp, Homo sapiens
cgcgcggccccctccagcttcttctgtcttcgtcccctggactgtccaacggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93165 - DNA, 1610 bp, Homo sapiens
cggccgcacgatggccgaggggcagggcggcggagggcagcgctgggactgggctggcggcggccgggcagccgaggaggaggtggtgcggcggcgatgccggcgcggggaggaggcccaggtcgcgcagccctggcccgagggttcccggggcacggccgctgggcccccggtggaggagcgtttccgccagctgcacctacgaaagcaggtgtcttacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaaggtgggtgggtagctcagctttgcccgcccctgccctttgggtgctgaggccctttcagcgcgcactcacacccacatgttatacaaacggcctgccaggagtgacccagcactcgggggtgaagagtcaaggaccctggagccaaatgcctgcgttcgaatcctggctcctcactgattagctgctgtatccccactgcctggaacaaacctggcgcctagtgggttcgttgaatatcactcaatggaatgaattgacgaatggtggcccttgtaccatttcaccatgtccaaactagtgcttagaagaggccattgatttgctgaagcttcataactcagctgtggctacaccctgcctctgtggagacctttccccaagggccattgtccactgtgcatttgcagctgggggcatgtctgggcactgtgcttctagaggtggaggcagcactgggcagacgggtcaaggccaggggcagaagggttcgcatggaggggcagcgcttcccagcctgcagaaacccaggccatcatacgggagagactgtaagactaggagtggttcaggcaggctcacacaggctgctttccccagcctctgaattgtaaagtgaggcttccttatacctctaataaggctgaagtagggacagttatgagaagggaaatagaaatgcagccccaagcactgtacactcatcatttaaggtggaaatcgacctagggttccacaaattagctaaaggtctccaggggccaggcagtgcaagtctgcgtgtgaggaccaggctggctgcgtgtgcccgggtcgggagtgccagagggcgaggaagaaaggatgcggccgagtgcggtggctcatgcctgtaatcccagcactttgggaggccgaggtaggtggatcaccctgaggtcaggagtttgagaccagcctggccaacatggtgaaaccccatctctactaaaaatcacaaaaattagccaggcgtggtgatgcacacctgtaatcccagctactcgggaggtggaggttgcagtgagccgagatcgcaccactgcactccagcctgggcaacagagcgagactctgtctcaaaaaacaa

SEQ ID NO: 93166 - DNA, 290 bp, Homo sapiens
agcgcttcctgcagccccgtgtgttgagccgtgtgggcagtcctcaggactgtgcccctgcccacccctcacccagtgaaatttttccccttctcccccagccaacctttgtacggcaccactgggtacacagacgacgccaggacggcaagtgtcggcactgtgggaaggtgagaggccctgcccgaggacatcgccacctgcacctgcgggcctgagcccaggccatgtggccggtgtggcctgccgatcactgaccacaccctggtgtgcagagtccggggctgacc

SEQ ID NO: 93167 - DNA, 425 bp, Homo sapiens
tttctgctctgtggcctggtaagatctggcccagagatggtacgtgagggtacaaagagggaacaaagtcacccagggggcctgctaaggatgatggtagggtgtcctggacgggaaggagcttacagcctctcaccttgtctcccaggagggccgctggagacccttcatcatcaggcccaccccctccccgctcatgaagcccctgctggtgtttgtgaaccccaagagtgggggcaaccaggtgaacgcggccttgcctctcagctaagggctcgggcgggggttggggtccagcccgtctgccagcagctgttcccagagcccgtttctggcttctaccccaatccctctttcccagggatcctgagaaaatcctgtcctttctccacccctcaccccttattggccctggttcccacagt

SEQ ID NO: 93168 - DNA, 3485 bp, Homo sapiens
gcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93169 - DNA, 769 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtcaagcaacgaggacaccagccactggacatcggccggggccaaaaacacgaagaacagaaagaaggatatagagagcg

SEQ ID NO: 93170 - DNA, 398 bp, Homo sapiens
agctcgttacccgacgctctctctgtggggtgcagccagctgctgacaggtgctctgttctccagctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccagagagcgtcggggtcctcagaccgaccgcagcagc

SEQ ID NO: 93171 - DNA, 316 bp, Homo sapiens
acatacaagtgcgtccacaactaagaacggacatgcatcaccaccacgaacgcattccaggcaccacgacgacaaattcccttccctccctggcccccactctatcccagcctggcctttgcttctctcaacaggagcccgatggtgctggagccaagtccccgacatgccagaaactgtcccccaagtggtgcttcctggacggtgagtctactcccagggtgccaagctgtttcgtgttccctccctaggggatcccaggtaggggcagcagaggacctgggcctggacatggcactccctgatcctcagctgc

SEQ ID NO: 93172 - DNA, 3682 bp, Homo sapiens
cggccgcacgatggccgaggggcagggcggcggagggcagcgctgggactgggctggcggcggccgggcagccgaggaggaggtggtgcggcggcgatgccggcgcggggaggaggcccaggtcgcgcagccctggcccgagggttcccggggcacggccgctgggcccccggtggaggagcgtttccgccagctgcacctacgaaagcaggtgtcttacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaaggtgggtgggtagctcagctttgcccgcccctgccctttgggtgctgaggccctttcagcgcgcactcacacccacatgttatacaaacggcctgccaggagtgacccagcactcgggggtgaagagtcaaggaccctggagccaaatgcctgcgttcgaatcctggctcctcactgattagctgctgtatccccactgcctggaacaaacctggcgcctagtggataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93173 - DNA, 3510 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaaggagtgacccagcactcgggggtgaagagtcaaggaccctggagccaaatgcctgcgttcgaatcctggctcctcactgattagctgctgtatccccactgcctggaacaaacctggcgcctagtggataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93174 - DNA, 1853 bp, Homo sapiens
tttctggcatgtcggggacttgactccagcaccatcgggctcctgctggagtctctcaatgtgcacacggcagagctctaggtcactgtctcctgggaccaccacagagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93175 - DNA, 2757 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctactgaagagggagcagcataagatcctctagataccttgaac

SEQ ID NO: 93176 - DNA, 1052 bp, Homo sapiens
aggatcccccggctgccgccctcttcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93177 - DNA, 2364 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccacgacgacgacgaattccggcacgacgacgacgaattccagcacgacgacgacgaatgccggcaccacg

SEQ ID NO: 93178 - DNA, 646 bp, Homo sapiens
gctgttgtcgacctcatgcaccgagtactggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 93179 - DNA, 1787 bp, Homo sapiens
ccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggtgagtgggccctgggcccatggtgcctgggagcacagcccaaaggtggaaggggtcacccatactcacctccatgggccacggcggcct

SEQ ID NO: 93180 - DNA, 6914 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcagcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagtgcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggca

SEQ ID NO: 93181 - DNA, 6848 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcagcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagtgcctacagctccaggaagccaggggaagcctgtctgtagaagatgagaggcagatggatgacttagagggagctgctcctcctattccccccaggctccactccgaggataaaaggaagacccctttgaaggaatcttacatcctttctgcagaacttggagaaaagtgtgaagacataggcaagaagctattgtacttggaagatcaacttcacacagcaatccacagtcatgatgaagatctcattcagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggca

SEQ ID NO: 93182 - DNA, 2368 bp, Homo sapiens
  misc_feature (1737)..(1737): n is a, c, g, or t
tcaaaagttatacacagattttcaactgtatagggccggggttggttcccataatccccgttgttcaagggccgactgtattatgtttttgcctagaatgtaagtctggagggctaagcattttatgatgtatccttgttacatcaacacaatacaaacagggcctgataactaagaggcactcagtaaatatttgttgaatgggtctatgaatagaagaagcaagtacaggtcacaatggaggtatagaggagggacatttaacacagactggaggagacgacacttgtgctaggggttgaaggaaatgtaggtgtgagccaggcaaagaatgggaggaagatgtttttcagggatcaagcccaaatccattcattggtaggccaagaattcattgtcagtaaatctttgggtctcctgttgagaagaacaatgattgtattagtcagttctcatgctgctaataaagacgtacccaagtctgggtaatttataaagaaaaagaggtttaacggactcacagttctacatggctggggaagcctcacaatcatggtggaaggcaaaggaggagaaaggcacatcttacacagtggcaggcaagagggcgcttgtgcaggggaactcccttttataaaaccatcagatctcatgagacatattcattatcatgagaacagcatgggaaagacccacccccatgattcaattacctcccacgacatgcgggaattatgggagctacaattcaagatgagatttgggtggggacacagccaaaccatatcaatgatgctaaatcaacccattggtaacactcagagaagtaactggatcactgagtctccatgtgggttaaataagactgcccttttctgtaatggaaaatatttgaaccttagggcttctcagaagggttttgtgagagctttgccatcattcttactcaagccttcaggacagcctgctgagcttaagttcatgctctttttctcttggtttctctgccaattttggtgtgtttaccttcataatttaaatgtgaggtttagaacagagaccatttggtcaggaaatttgtattccttctcattatgcatttcttcatgcagatgagggcacagtgtgatgtttttgtttaaaataaaataacattttaactttttatgtggatgttatgctcaaattacactttttctttacatagattttttttggagaaactaatgcatctggcattgaaaaaatgtgcatttttgttttttttttaaaaagagaatgaagaagttcagttttgaaacagtttctaaatgttcttagttttcacaaaaatgtttgcttgaattctattgtaattttttattttttcccctttaaaccaacataggtaatatccttaagattaaaacttcagaaacttcaggaagatgcagttgagaatgatgattatgataaaggtgagttttaatttgtttattgattgttttgtcatcatgtcccaattttctttccatctttactcatatctaccttttgaatcccaaaagaattgtacaatctgttcctctgatcatctctaccagggaatagttgactcttttacagcattattgttttgtagatttcaaagtacttcatgaacattaatcctttgggttataaatataaccttatcaattgtccagaaacacttagcatactcacacaataaaaattatattagcttgccacctgtcngcccatggtgtgatgtatctataatccacttgttcataaaaaatattcgtctgacacctatgatatgctagggaatatgggagacaataggaaagtaagacagacatggtatctgcccttgtgatgccagtaaacttaagccttcatggggctctctgacttcataatttccagaaccagagataggaaatgaggtgaatttgagaaatgtcagactgtgccaaagggggtcacatgcatcaaatttccacatacatggcctaaaatacccaagagaaaaagaagttacaacattagaccagagatagagggactgatctgaggccaggaaaacaaacaaacaaaaaaacaaaaaaaccaattaaaatgaggcaccaaaatagaagttgggctgcaagcagatgagggctgacatgggggttgaatgggcacagggtagactgagtcaaaggaaagctttcaggtatggttgtcctgggaacaatcctgaaaactttagatgctcattgcaagatctcacacccatttctgctgggtgtgggaaagagaaagggctgaaaatgacatgtagattcccctaggcacctactaacttgatagatactcctgctattgagcaagttaggacacc

SEQ ID NO: 93183 - DNA, 2146 bp, Homo sapiens
  misc_feature (1)..(1): n is a, c, g, or t
  misc_feature (1515)..(1515): n is a, c, g, or t
nttgctcacccaagatgcctccagaagaaagcagaaacttccgagaggagcgtgaatgctctgtttctgtgctgcagaaacaattcctagtttatttgtttcctaaattaagtttatcttattggtttttgtttttccaaaagcaatgcatgctcattacaggaagcacagaaagctacaaacaagcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcagcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaaggtgagttttaatttgtttattgattgttttgtcatcatgtcccaattttctttccatctttactcatatctaccttttgaatcccaaaagaattgtacaatctgttcctctgatcatctctaccagggaatagttgactcttttacagcattattgttttgtagatttcaaagtacttcatgaacattaatcctttgggttataaatataaccttatcaattgtccagaaacacttagcatactcacacaataaaaattatattagcttgccacctgtcngcccatggtgtgatgtatctataatccacttgttcataaaaaatattcgtctgacacctatgatatgctagggaatatgggagacaataggaaagtaagacagacatggtatctgcccttgtgatgccagtaaacttaagccttcatggggctctctgacttcataatttccagaaccagagataggaaatgaggtgaatttgagaaatgtcagactgtgccaaagggggtcacatgcatcaaatttccacatacatggcctaaaatacccaagagaaaaagaagttacaacattagaccagagatagagggactgatctgaggccaggaaaacaaacaaacaaaaaaacaaaaaaaccaattaaaatgaggcaccaaaatagaagttgggctgcaagcagatgagggctgacatgggggttgaatgggcacagggtagactgagtcaaaggaaagctttcaggtatggttgtcctgggaacaatcctgaaaactttagatgctcattgcaagatctcacacccatttctgctgggtgtgggaaagagaaagggctgaaaatgacatgtagattcccctaggcacctactaacttgatagatactcctgctattgagcaagttaggacacc

SEQ ID NO: 93184 - DNA, 5127 bp, Homo sapiens
tgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatgaaacaagtgtgaaggaaaatactatgaagtacatggaaacacttaagaataaactgtgcagctgcaagtgtccactgcttgggaaagtgtgggaagctgacttggaagcttgtcgattgcttatccagtgcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggca

SEQ ID NO: 93185 - DNA, 7350 bp, Homo sapiens
tcaaaagttatacacagattttcaactgtatagggccggggttggttcccataatccccgttgttcaagggccgactgtattatgtttttgcctagaatgtaagtctggagggctaagcattttatgatgtatccttgttacatcaacacaatacaaacagggcctgataactaagaggcactcagtaaatatttgttgaatgggtctatgaatagaagaagcaagtacaggtcacaatggaggtatagaggagggacatttaacacagactggaggagacgacacttgtgctaggggttgaaggaaatgtaggtgtgagccaggcaaagaatgggaggaagatgtttttcagggatcaagcccaaatccattcattggtaggccaagaattcattgtcagtaaatctttgggtctcctgttgagaagaacaatgattgtattagtcagttctcatgctgctaataaagacgtacccaagtctgggtaatttataaagaaaaagaggtttaacggactcacagttctacatggctggggaagcctcacaatcatggtggaaggcaaaggaggagaaaggcacatcttacacagtggcaggcaagagggcgcttgtgcaggggaactcccttttataaaaccatcagatctcatgagacatattcattatcatgagaacagcatgggaaagacccacccccatgattcaattacctcccacgacatgcgggaattatgggagctacaattcaagatgagatttgggtggggacacagccaaaccatatcaatgatgctaaatcaacccattggtaacactcagagaagtaactggatcactgagtctccatgtgggttaaataagactgcccttttctgtaatggaaaatatttgaaccttagggcttctcagaagggttttgtgagagctttgccatcattcttactcaagccttcaggacagcctgctgagcttaagttcatgctctttttctcttggtttctctgccaattttggtgtgtttaccttcataatttaaatgtgaggtttagaacagagaccatttggtcaggaaatttgtattccttctcattatgcatttcttcatgcagatgagggcacagtgtgatgtttttgtttaaaataaaataacattttaactttttatgtggatgttatgctcaaattacactttttctttacatagattttttttggagaaactaatgcatctggcattgaaaaaatgtgcatttttgttttttttttaaaaagagaatgaagaagttcagttttgaaacagtttctaaatgttcttagttttcacaaaaatgtttgcttgaattctattgtaattttttattttttcccctttaaaccaacataggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagtgcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaattgc

SEQ ID NO: 93186 - DNA, 448 bp, Homo sapiens
tgtttatggtgctgttttttcttttcttcccaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctggga

SEQ ID NO: 93187 - DNA, 219 bp, Homo sapiens
ctggagaaaaaatttatactcagagttcaattattccctatatatttataggcgtcaaatcaatacttacagttccagtccttcacctgatcttcagtatatctaatttccctcaaatgatatatcaatacactagctctctttgtattaacatatatatgtgttcaaagcataaaagtacagaaggccgggtgcggtggctcacacctgtaatcccag

SEQ ID NO: 93188 - DNA, 2272 bp, Homo sapiens
gcataggctaggtagcgaggccgcgtgtgaatcggccgaggccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93189 - DNA, 2128 bp, Homo sapiens
gccctaatgtggaacgctccgcttaatgcttggcgatatgttactgtgctcatagggactgagtgtgagatgctgtacagcccagccacggatacacagttcaggtcagactagatcattacagcagcagaggagggtatgggcatggagaggggaaagctctcactgtcaggcacctccgcatcccagacacaggcctcggtcctccatttatgcaatgtcctcattttacaaacaagaaaagcagcacgggaagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggaagggagaggaggagaggaacagtgttatttgggggtcacagctctgcgtttgcaggccacgttctttcccatctccaccgaatgtacaagcgcttgcgtgtcggcctctgtggcaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93190 - DNA, 510 bp, Homo sapiens
atctacaggagcttaattcggccgggacatcctgggggagctagccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggtgcgtggtccctgcagcccctgacaggagcaggggccatgtagccaccactgccctgggccgcctgcttccctggtggctgggggaggcatgctgcctcctgcccttcccaacaggaagggtgccagtctctgcagggcggtctggccctgtgaccagaaggagatgtgttcggaggctctaggccaagcgagctccatccgatactcagtaggagaggctggagcgctgctctctcagccgttcctgggga

SEQ ID NO: 93191 - DNA, 595 bp, Homo sapiens
tgtagtcccagctacttgggaggctgaggcaggaaaaacatattaattttagaatgtagaaataaacataaaatcaaaactgcaccagcctggccaacatggcaaaccccgtctcaactaaaaatacaaaacttagccagctgggtgcagtgactcacgcctgtaattccagcagtttgagaggccaaggtgggcaaatcacaaggtcaagagattgagaccagcctggccaacgtgctgaaaacccgtctctactaaaatacaaaaaaattagctgggcgtggtgccgcacacctgtagtcccagctacttgggaggctgaggcaggaaaattgtttgaacccgggaggcacaggttgcagtgagtggagatcgtgccactgcactccatcctggcgacagaggaagactccgtctcaaaaaaaaaaaaaaaaaaaaaaattgggcgtggtgggttgtgcctgtagtcccagctactcaggaggctgaggcaggagaatcccttgaacccggaaggagggggttgccgtgagctgagatcacgccactgcactccagcctgggtgacagagtgactccatctcaaaaaaaaaaa

SEQ ID NO: 93192 - DNA, 179 bp, Homo sapiens
  misc_feature (5)..(5): n is a, c, g, or t
cgtantaggcaggacactgtagagatggctagataccgacagagatggggagggcggggaggatgggatggagttgacacatgacagagacgcctggaggggactcctcgggggcctgcctgtgtcaactcccctcccagctcccacctccctcctcccagctcccggctcccacctcc

SEQ ID NO: 93193 - DNA, 628 bp, Homo sapiens
cacgcctgcctcagctgagttggtctccctcatcctgttcccgctgtccacagccccaccctaagctgatgaggaagcctcacgggccacccggggaatccagggcctgtgctcagctgctgctgctctgccccctggcggcccctccgtgtccctgcgagggaggcagctggcaggcagccccgtgagccgggttgggtcccacgagtctcagttcagtgtcgtttctgacttttcttgactttctttcaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93194 - DNA, 641 bp, Homo sapiens
tagtggggagttaggtggcccctggcctgggcatgtcaggttctgagttcttgctttaagtcatataattggttcagcttagcaataataactagcctattttgagttggggggacgttgtgagtgtcgacccggtaattcccccgtttttgtttttgtttttggagtcggaatctcactctgtcgcctaagctagagtgcattggcgcagtctcggcccgggttcaagcgattcgcctgcctcagccttccgagtaactggaattacaggcacacgccaccacacccggctaatttttgtatttttattagagaccaggttttgccacgttggccaggctggtcttgaactcctgatatcaagtgatcctcctgtaatcctagcactttgggaggccgaggtgggcggatcacgaggtcaggagatcgagaccatcctgactaacacggtgaaaccacgtctctactaaaaatacaaaaaattagccgggcgtgttggcgggcacctgtagtcccagctacttgggaggctgaggcaggagaatggcatgaacccaggaggcagagcttgcagtgagccgagatcgcgccactgcactccagcctgggcaacatagtgagactccgtctcaaaaaaaaag

SEQ ID NO: 93195 - DNA, 436 bp, Homo sapiens
cctgacagcatgtgtgaaatccctctttaagatgggcctcctccgaggagctgtgaggggtgagggtgaaatccctccttaagacgagcctcctctgaggggctgtgaggggtgagggtgaaatccctccttaagacgggcctccggccgggcgcggtggctcacgcctgtaatcctagcactttgggaggccgaggtgggcggatcacgaggtcaggagatcgagaccatcctgactaacacggtgaaaccacgtctctactaaaaatacaaaaaattagccgggcgtgttggcgggcacctgtagtcccagctacttgggaggctgaggcaggagaatggcatgaacccaggaggcagagcttgcagtgagccgagatcgcgccactgcactccagcctgggcaacatagtgagactccgtctcaaaaaaaaag

SEQ ID NO: 93196 - DNA, 2232 bp, Homo sapiens
gcataggctaggtagcgaggccgcgtgtgaatcggccgagggtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93197 - DNA, 3215 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggtaagggagaaaggctgaaatgggagctctgtgtaagccggtcacatgcacgtcccttctgctccgggcggtccacatgcaggcgtgcgtggtgcgggctccctcagcagcccagccccgccacggcaggggcagggtctagtgcagagggctcctcctttcctggcagcccgggttcggatgcttgttgttttgagagagaaatcctttggggctcagagcacaagctgagtcgtcaccgtggtgagctgctccatccgtggtcttgtgagcgcgtggtgcggctgctgggggattctctgtagtcgtggggtgtagtcctgctctgacgcctcctgtgctggaggtgccgtttctgtctcaaaacctaaggagtttgtactgttgttaagggataagatagaacgagtgagaaaaccagcaagtcagagggtcgcaggaccgtggaccgtccactggggacagcttagtgcctcctggtttaacttcagctgctctgcgggcccttatgaccggcatggctggctttgtctggggctgtgagcttctgactctcctcagtagagtggcagcacgtggcactgtgcaacccgagggcagctcagggtccctgtagcctgcatttgctgaagtgggagcttctgacacgtggtgaagatgttggcaggcttgagcggcacgtgacccccttccttccccaccacacactctggtgtgcagggcagacgccgtgcaggttcatctcgactcccgtgagtgtcctggtggcagaaggactgtcccaccctcacccaaagctcgttggtacaaaaagcacagccgtttctgtcagactctgtggctatctctcagcagatgcatccagtccatgctggagtcgacagaaggactctgctgggagaggtagaggccccctggcagcatctgtagcatcttcgttttatgtccctttctgaaggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93198 - DNA, 2399 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggaagggagaggaggagaggaacagtgttatttgggggtcacagctctgcgtttgcaggccacgttctttcccatctccaccgaatgtacaagcgcttgcgtgtcggcctctgtggcaggtgcgagtgacacagtggaagcaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93199 - DNA, 2212 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtgctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93200 - DNA, 2466 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgttctttggctgattatcatttgtatcttttagctgtaaaaaacatttgtacatatagtgctttccggatgtgttagtcagggaaggctctattacagtatactaaaccatagaaatgtatttttcacagttctggaggctagaagtctgggacagggtgccagcatggttggagtctcgcgtgggagccccattctggcttgcaggtagccagcgtctccttgtgtcctctgcagggc

SEQ ID NO: 93201 - DNA, 2075 bp, Homo sapiens
ttgcaagctcggacccgtatcattttcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93202 - DNA, 2439 bp, Homo sapiens
gcataggctaggtagcgaggccgcgtgtgaatcggccgaggccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctggaaaaatggacattttcctctccccctaaaaaaagataaaactccttcctggttattaactgaaatgctgatcgagctttatcctaaagaagatcagtcgtggacaagaaccttgtgaaatgttccccatttgagaccctaaaactaatgaaaatcacagcttttggataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93203 - DNA, 2119 bp, Homo sapiens
ggcacgaggctcacagacgctggtgggcaccagggaacaaaggaaggggagaggtctggctgtgcgctcacagacgctgtggcaccagggaacaaaggaaggggtcagcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93204 - DNA, 2238 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgaccgcttcgagctgataaacattgacgatcttgaggatgaccctgtggtgaacggggagaggtctggctgtgcgctcacagacgctgtggcaccagggaacaaaggaacggggtcagcgtggcaacacagagagcaagacggatggagatgacatccgagactagtgccctcaggccg

SEQ ID NO: 93205 - DNA, 2637 bp, Homo sapiens
  misc_feature (2593)..(2593): n is a, c, g, or t
  misc_feature (2603)..(2603): n is a, c, g, or t
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggaagggagaggaggagaggaacagtgttatttgggggtcacagctctgcgtttgcaggccacgttctttcccatctccaccgaatgtacaagcgcttgcgtgtcggcctctgtggcaggtgcgagtgacacagtggaagcaggtgtgcagtgaagtggggaaaacatattaattttagaatgtagaaataaacataaaatcaaaactgcaccagcctggccaacatggcaaaccccgtctcaactaaaaatacaaaacttagccagctgggtgcagtgactcacgcctgtaattccagcagtttgagaggccaaggtgggcaaatcacaaggtcaagagattgagaccagcctggccaacgtgctgaaaacccgtctctactaaaatacaaaaaaattagctgggcgtggtgccgcacacctgtagtcccagctacttgggaggctgaggcaggaaaattgtttgaacccgggaggcacaggttgcagtgagtggagatcgtgccactgcactccatcctggcgacagaggaagactccgtctcaaaaaaaaaaaaaaaaaaaaaaagacgggcctcctccgaggggctgtgaggggtgagggtgaaatccctccttaagacgggcctcctccgaggggctgtgaggggtgagggtgaaatccctccttaagatgggcctcctccgaggggctgtgaggggtgagggtgaantccctccttnaagacgggcctccggccgggtcgcggtggttcaa

SEQ ID NO: 93206 - DNA, 2026 bp, Homo sapiens
  misc_feature (1895)..(1895): n is a, c, g, or t
  misc_feature (1898)..(1898): n is a, c, g, or t
  misc_feature (1907)..(1907): n is a, c, g, or t
  misc_feature (1909)..(1909): n is a, c, g, or t
  misc_feature (1914)..(1914): n is a, c, g, or t
  misc_feature (1925)..(1925): n is a, c, g, or t
  misc_feature (1959)..(1959): n is a, c, g, or t
  misc_feature (1984)..(1984): n is a, c, g, or t
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagagaaccaaaaaacaancgngccgcacangnagcgnaacaatattanttgaggggtcaaaaatatgaagattaaaaggacnaagagaaatatataaaaatatccangagagaaaaaaaaagaagccttgccatgatcggacctgctgg

SEQ ID NO: 93207 - DNA, 2880 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggtaagggagaaaggctgaaatgggagctctgtgtaagccggtcacatgcacgtcccttctgctccgggcggtccacatgcaggcgtgcgtggtgcgggctccctcagcagcccagccccgccacggcaggggcagggtctagtgcagagggctcctcctttcctggcagcccgggttcggatgcttgttgttttgagagagaaatcctttggggctcagagcacaagctgagtcgtcaccgtggtgagctgctccatccgtggtcttgtgagcgcgtggtgcggctgctgggggattctctgtagtcgtggggtgtagtcctgctctgacgcctcctgtgctggaggtgccgtttctgtctcaaaacctaaggagtttgtactgttgttaagggataagatagaacgagtgagaaaaccagcaagtcagagggtcgcaggaccgtggaccgtccactggggacagcttagtgcctcctggtttaacttcagctgctctgcgggcccttatgaccggcatggctggctttgtctggggctgtgagcttctgactctcctcagtagagtggcagcacgtggcactgtgcaacccgagggcagctcagggtccctgtagcctgcatttgctgaagtgggagcttctgacacgtggtgaagatgttggcaggcttgagcggcacgtgacccccttccttccccaccacacactctggtgtgcagggcagacgccgtgcaggttcatctcgactcccgtgagtgtcctggtggcagaaggactgtcccaccctcacccaaagctcgttggtacaaaaagcacagccgtttctgtcagactctgtggctatctctcagcagatgcatccagtccatgctggagtcgacagaaggactctgctgggagaggtagaggccccctggcagcatctgtagcatcttcgttttatgtccctttctgaaggacgtgaccacgcagtctgtgatggggtttgatcctctgcctccttcggacacaatctactcctacgtcaggccagagagtcgttattcaccaccgccctctagagtgtgaggaaaatgtt

SEQ ID NO: 93208 - DNA, 2191 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93209 - DNA, 1807 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggtgagctaggggttgacacaagccctgccacgccccctcctcagggaccctcatcccagacacgggggcctcgcattcgggaggcgagaagggctgt

SEQ ID NO: 93210 - DNA, 2010 bp, Homo sapiens
gccctaatgtggaacgctccgcttaatgcttggcgatatgttactgtgctcatagggactgagtgtgagatgctgtacagcccagccacggatacacagttcaggtcagactagatcattacagcagcagaggagggtatgggcatggagaggggaaagctctcactgtcaggcacctccgcatcccagacacaggcctcggtcctccatttatgcaatgtcctcattttacaaacaagaaaagcagcacgggaagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93211 - DNA, 1401 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggtgagtgcagctgccctggaggtgacgcagctccccttcccttctcctgcgagtgaggctgggggaggtgcagtgggcacctcatggctgccctccagggtggaccagggcccacaggtccagagtgacccaccttcctctctctgggcttaaggatagagggatgggattgtctcagcccaggtttacctttgtctgtggacatgcctgatgctactgtggaggtcagagtgggaggtctgctgagcccaggagttcaagtccagcctgggcaccatagtgagacccccatctctt

SEQ ID NO: 93212 - DNA, 1213 bp, Homo sapiens
ctcgaggacttgtctagccgcgcagtggggctgcgtctgattaccgcagaccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93213 - DNA, 1163 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggtgcgtggtccctgcagcccctgacaggagcaggggccatgtagccaccactgccctgggccgcctgcttccctggtggctgggggaggcatgctgcctcctgcccttcccaacaggaagggtgccagtctctgcagggcggtctggccctgtgaccagaaggagatgtgttcggaggctctaggccaagcgagctccatccgatactcagtaggagaggctggagcgctgctctctcagccgttcctgggga

SEQ ID NO: 93214 - DNA, 1339 bp, Homo sapiens
gcataggctaggtagcgaggccgcgtgtgaatcggccgaggcccgccacggcaggggcagggtctagtgcagagggctcctcctttcctggcagcccgggttcggatgcttgttgttttgagagagaaatcctttggggctcagagcacaagctgagtcgtcaccgtggtgagctgctccatccgtggtcttgtgagcgcgtggtgcggctgctgggggattctctgtagtcgtggggtgtagtcctgctctgacgcctcctgtgctggaggtgccgtttctgtctcaaaacctaaggagtttgtactgttgttaagggataagatagaacgagtgagaaaaccagcaagtcagagggtcgcaggaccgtggaccgtccactggggacagcttagtgcctcctggtttaacttcagctgctctgcgggcccttatgaccggcatggctggctttgtctggggctgtgagcttctgactctcctcagtagagtggcagcacgtggcactgtgcaacccgagggcagctcagggtccctgtagcctgcatttgctgaagtgggagcttctgacacgtggtgaagatgttggcaggcttgagcggcacgtgacccccttccttccccaccacacactctggtgtgcagggcagacgccgtgcaggttcatctcgactcccgtgagtgtcctggtggcagaaggactgtcccaccctcacccaaagctcgttggtacaaaaagcacagccgtttctgtcagactctgtggctatctctcagcagatgcatccagtccatgctggagtcgacagaaggactctgctgggagaggtagaggccccctggcagcatctgtagcatcttcgttttatgtccctttctgaaggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93215 - DNA, 762 bp, Homo sapiens
gaacttcgagttggtacctgaacattcgtgtccccccttccttccccaccacacactctggtgtgcagggcagacgccgtgcaggttcatctcgactcccgtgagtgtcctggtggcagaaggactgtcccaccctcacccaaagctcgttggtacaaaaagcacagccgtttctgtcagactctgtggctatctctcagcagatgcatccagtccatgctggagtcgacagaaggactctgctgggagaggtagaggccccctggcagcatctgtagcatcttcgttttatgtccctttctgaaggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93216 - DNA, 1781 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaagagacagggtcttgctgggttgtccagtctggttttgaactcgtggcctcaagtgatcctcccatctcagtctcccaaatagctgggactaccggcacatgccaccgctaatttattttattttattttttatagaaacaaggtcttactttgttgcccagggtgatgtcaaactcctggcttcaagcgattctcctccctctacctcctaaagtgctaggattacaggcatgagccaccacgcccagccagacacatcctgttttattggaccatggagagtattgctggtctataacatgccctgggtttgcacgtctgagttctttttttttttttcgagacagaattttgctcttgttgcccaggctggagtgcaatggctcaatcttggctcaccacaacctccgcctcccgggttcaagtgattctcctgcctcagcttcccaagtagctgggattacaggcgagtgccaccatgctcggcaaatttttgtatttttggtagagacggggtttcaccatgttggccaggctggtctcgatctcctgacctcaagtgatccgccagtctcggcctcccaaagtgctgggattacagccctgagccactgcgcccggcctcccaaagtgctgggattacaggcgtgagccaccacacccagcctaagtgttgtttctgcaccatggtatacccaggtcatttcctcaccccaatggtagcatgtgtccagatgttggctacagtccccggtgtctgcaggcatttctgtgaaactgcccaagaatgagtatatatcctgcatgctgccagtgccttcagtagagttacgtggctcacactgagtgtctgcccaggtccttcaccttcttactcgtagtcgacggtagtggtttggaaacctgccgtcgtgtgtgggcagaagtgttggggttttgattgtgggtagatcaaggatgttttcatatgctgttgttcacgccttccctggatttctaacaggttttgctttatattttactttacatttttggtgttgatgggtttcttcgggaatattaattaaaaatagactttaaaatgtc

SEQ ID NO: 93217 - DNA, 610 bp, Homo sapiens
tctacctcgcgggtgcctctacctggctgcctctttcagacccagatgctgagagatggggctcagggctaagtgggtctttcccctcacaggaagggagaggaggagaggaacagtgttatttgggggtcacagctctgcgtttgcaggccacgttctttcccatctccaccgaatgtacaagcgcttgcgtgtcggcctctgtggcaggtgcgagtgacacagtggaagcaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93218 - DNA, 403 bp, Homo sapiens
  misc_feature (2)..(2): n is a, c, g, or t
tnccgctacggacgccacgctgcctcagctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93219 - DNA, 921 bp, Homo sapiens
gcataggctaggtagcgaggccgcgtgtgaatcggccgaggccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctggaaaaatggacattttcctctccccctaaaaaaagataaaactccttcctggttattaactgaaatgctgatcgagctttatcctaaagaagatcagtcgtggacaagaaccttgtgaaatgttccccatttgagaccctaaaactaatgaaaatcacagcttttggataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93220 - DNA, 510 bp, Homo sapiens
gcataggctaggtagcgaggccgcgtgtgaatcggccgaggccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaacataggaagaagctcgtgccgaattcggcacgagctcgtgc

SEQ ID NO: 93221 - DNA, 188 bp, Homo sapiens
gaaaaatggacattttcctctccccctaaaaaaagataaaactccttcctggttattaactgaaatgctgatcgagctttatcctaaagaagatcagtcgtggacaagaaccttgtgaaatgttccccatttgagaccctaaaactaatgaaaatcacagcttttgggtaggtaataaggtgttttgt

SEQ ID NO: 93222 - DNA, 385 bp, Homo sapiens
cgggttcaagcgattcgcctgcctcagccttccgagtaactggaattacaggcacacgccaccacacccggctaatttttgtatttttattagagaccaggttttgccacgttggccaggctggtcttgaactcctgatatcaagtgatcctcctgcctcagcctcccaaagtggtgggattacaggcgtgagccactgcgcccagcctccgctggttttaaatgtctgaaaaaaaggcatgcctgggagctggggccttgctgagtgcctttcctccagggctgtcctcccttctggtaggttctgctccagacgagcccttaccacgttgactcactcctgcagctcagcgatgcctgccgctttcaagaggatcaggagatg

SEQ ID NO: 93223 - DNA, 563 bp, Homo sapiens
tcaccgagcgccctcacggcacagtgacggcagcttccccatggtgcccgcagtggcgaggcctcagctgtggttggggtggtgattttagagaaaggcctggaagctgcctttcaaaccaaaaatccgtgttctctccttgactattaggtggctttctgaagcttttggaatcgtcttagaacataatttcatgttttttttctacaattttcaattccccagacacttgaatccagacacagaactgaaaaggtattttggtgcccgggcaatcctgggggagcaaagggtaaggtccacagtgagctgcattctcacagctgcttcattccttcttagactcttggccgggggtggtgttcctgaagctagtttacccttgagggagagtatttaaagccagagtgcacacgtaacccttagaattggggtctgaatgggagtccacagattgtctgtgtataaccttgtctgtgaccgtgggttgtagagatgctcagagtagctggtctccatccctcacactgccttgtccagcatgaggtttcaaaagccatgcc

SEQ ID NO: 93224 - DNA, 268 bp, Homo sapiens
ccaccctaagctgatgaggaagcctcacgggccacccggggaatccagggcctgtgctcagctgctgctgctctgccccctggcggcccctccgtgtccctgcgagggaggcagctggcaggcagccccgtgagccgggttgggtcccacgagtctcagttcagtgtcgtttctgacttttcttgactttctttcaggctaagtcctatcagccatggaaacaccattgctctcttcttccggtcactgttgccaaactataccatgg

SEQ ID NO: 93225 - DNA, 490 bp, Homo sapiens
tgcctggcttggtctagacacggcatttggttttgagagcttcctcctcacagggacctggggagggttcagggtccggtgctggggcaagggccacctcgggctccacagtgcctcctgcttgggccccgggcccctagtcccagcacagacagcccccttctcagacatgtccccttgctgcagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgct

SEQ ID NO: 93226 - DNA, 793 bp, Homo sapiens
  misc_feature (793)..(793): n is a, c, g, or t
gcataggctaggtagcgaggccgcgtgtgaatcggccgaggccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaagggccaggcgagacacgtgtgtccccaagtgcctggctgacaccctaaagactggccgttagaacaggtggctgcggtgtgan

SEQ ID NO: 93227 - DNA, 2257 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93228 - DNA, 2223 bp, Homo sapiens
agaagttacggctaggtacgaggctgggtgtggtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93229 - DNA, 2621 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgcaaaaaaaaaaaaaaaccaaaaaaaaaaaaacaaaaaaaaaaaagtgacagaaggcagtaatacaggagcacaagctgagggtgcggacgagagcaagtggagcaggaacgaagagggagggaaggagagtggggagctagagcgtgagggtggagagcggcacgagcacgagcggaggagagaggacgagcgacagacccaagcagtagataggagaagggagggagggtcggagcaggtggcggaggtgggtgttggagcatcgcctcagatggcatcgatgcgtgtgagtggggcgaagtaggtgaagagggaagtgtgaaggggatgggagatgttggtagtgaggtggtgaccagattga

SEQ ID NO: 93230 - DNA, 2755 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgctctgccgtccgcaccttctcctttcgcaggcactgagcgccgtcccatgccctcggattcgaatcacactcagtccattctcctcccagtggcttgtgggtgaggtggggcccagaccccatgcttcctgtgctcccaggatctgggcacgggtggagaaggggccccacggggtcttcagtgcaggtccctgctgaatgccaaggccctgggtgcacgtcctccttgaacttgctgtggagttcgtcaacagagctgcgtgccttgttggtagagggtctcagggcagggctggagcagagaggcccctatgtggcagccggccttcagtcttgttcctccaagcaagtggggtggagatgttggggtcctttggctggatgccactatctgttgaatctgacaaaataattttcttttttttttttgagacaagagtctcactgcactccagcctgggtgacagagtgactccatctcaaaaaaaaaaaagcaaaa

SEQ ID NO: 93231 - DNA, 2355 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttggtccgagcggaccggtcctgctcggaccaatttgtaagtgtaactgttcctccttggtatttgtgtaatatcctgtacatatctttgagttcaacctttagtatcgtgtggctttggtcactt

SEQ ID NO: 93232 - DNA, 2201 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtgagggtctgcggctgctgggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93233 - DNA, 1823 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataaggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93234 - DNA, 1784 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93235 - DNA, 3163 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggtaagggagaaaggctgaaatgggagctctgtgtaagccggtcacatgcacgtcccttctgctccgggcggtccacatgcaggcgtgcgtggtgcgggctccctcagcagcccagccccgccacggcaggggcagggtctagtgcagagggctcctcctttcctggcagcccgggttcggatgcttgttgttttgagagagaaatcctttggggctcagagcacaagctgagtcgtcaccgtggtgagctgctccatccgtggtcttgtgagcgcgtggtgcggctgctgggggattctctgtagtcgtggggtgtagtcctgctctgacgcctcctgtgctggaggtgccgtttctgtctcaaaacctaaggagtttgtactgttgttaagggataagatagaacgagtgagaaaaccagcaagtcagagggtcgcaggaccgtggaccgtccactggggacagcttagtgcctcctggtttaacttcagctgctctgcgggcccttatgaccggcatggctggctttgtctggggctgtgagcttctgactctcctcagtagagtggcagcacgtggcactgtgcaacccgagggcagctcagggtccctgtagcctgcatttgctgaagtgggagcttctgacacgtggtgaagatgttggcaggcttgagcggcacgtgacccccttccttccccaccacacactctggtgtgcagggcagacgccgtgcaggttcatctcgactcccgtgagtgtcctggtggcagaaggactgtcccaccctcacccaaagctcgttggtacaaaaagcacagccgtttctgtcagactctgtggctatctctcagcagatgcatccagtccatgctggagtcgacagaaggactctgctgggagaggtagaggccccctggcagcatctgtagcatcttcgttttatgtccctttctgaaggacgtgaccacgcagtctgtgatggggtttgatcctctgcctccttcggacacaatctactcctacgtcaggccagagagaggtacctccctccttccagttcccacctcccacaggtgtatctaggaaggcttctgccctggctgggcctgcccccgctaaccggctttttgcccaaatgggccattatcgaagaattcacaaaaaacaatagcctcatcatccccaccatcatagccaccatcaccctccttaacctctacttctacctacgcctaatctactccacctcatcacactactccccatatctacacgtaaaaataaaatgacagtttgacatacaaacccacccattcctccccaccgcatcacccttcgggatcctctagatcaccttagca

SEQ ID NO: 93236 - DNA, 2498 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggtaagggagaaaggctgaaatgggagctctgtgtaagccggtcacatgcacgtcccttctgctccgggcggtccacatgcaggcgtgcgtggtgcgggctccctcagcagcccagccccgccacggcaggggcagggtctagtgcagagggctcctcctttcctggcagcccgggttcggatgcttgttgttttgagagagaaatcctttggggctcagagcacaagctgagtcgtcaccgtggtgagctgctccatccgtggtcttgtgagcgcgtggtgcggctgctgggggattctctgtagtcgtggggtgtagtcctgctctgacgcctcctgtgctggaggtgccgtttctgtctcaaaacctaaggagtttgtactgttgttaagggataagatagaacgagtgagaaaaccagcaagtcagagggtcgcaggaccgtggaccgtccactggggacagcttagtgcctcctggtttaacttcagctgctctgcgggcccttatgaccggcatggctggctttgtctggggctgtgagcttctgactctcctcagtagagtggcagctgggaggtgggaactggaaggagggaggtacctctcttgcctgacgtaggagtagattgtgtccgaaggaggcagaggatcaaagcccatcacagactgcgtggtcacgtccttcagaacggga

SEQ ID NO: 93237 - DNA, 2165 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggccacggcagagacaacgtgtgtaccccaagtgcacatggctgaccacccctaaaagcacctggccccgctacagcaaaccaggtgagggtctgcggctgctgggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93238 - DNA, 1421 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93239 - DNA, 1235 bp, Homo sapiens
ctgatgctgaaggtgactctaaggatccgtcctatctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93240 - DNA, 1202 bp, Homo sapiens
agatcggtctagctgcagtggggctgcggtgatacgagaccgagaacatgagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93241 - DNA, 518 bp, Homo sapiens
tgaatgtagattatatgctaatttaaattatatattggaggtcgagaaaagagtactttagagacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgc

SEQ ID NO: 93242 - DNA, 1852 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaagagacagggtcttgctgggttgtccagtctggttttgaactcgtggcctcaagtgatcctcccatctcagtctcccaaatagctgggactaccggcacatgccaccgctaatttattttattttattttttatagaaacaaggtcttactttgttgcccagggtgatgtcaaactcctggcttcaagcgattctcctccctctacctcctaaagtgctaggattacaggcatgagccaccacgcccagccagacacatcctgttttattggaccatggagagtattgctggtctataacatgccctgggtttgcacgtctgagttctttttttttttttcgagacagaattttgctcttgttgcccaggctggagtgcaatggctcaatcttggctcaccacaacctccgcctcccgggttcaagtgattctcctgcctcagcttcccaagtagctgggattacaggcgagtgccaccatgctcggcaaatttttgtatttttggtagagacggggtttcaccatgttggccaggctggtctcgatctcctgacctcaagtgatccgccagtctcggcctcccaaagtgctgggattacagccctgagccactgcgcccggcctcccaaagtgctgggattacaggcgtgagccaccacacccagcctaagtgttgtttctgcaccatggtatacccaggtcatttcctcaccccaatggtagcatgtgtccagatgttggctacagtccccggtgtctgcaggcatttctgtgaaactgcccaagaatgagtatatatcctgcatgctgccagtgccttcagtagagttacgtggctcacactgagtgtctgcccaggtccttcaccttcttactcgtagtcgacggtagtggtttggaaacctgccgtcgtgtgtgggcagaagtgttggggttttgattgtgggtagatcaaggatgttttcatatgctgttgttcacgccttccctggatttctaacaggttttgctttatattttactttacatttttggtgttgatgggtttcttcgggaatattaattaaaaatagactttaaaatgtcactttgtcatctgcatttctctgagctgagggttccacctcgtcccaccctttgtttgcatctgcttggtc

SEQ ID NO: 93243 - DNA, 573 bp, Homo sapiens
  misc_feature (553)..(553): n is a, c, g, or t
  misc_feature (572)..(572): n is a, c, g, or t
gcataggctaggtagcgaggccgcgtgtgaatcggccgaggccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcgggttggggaagaagcaaagactctttncctattttgtatgtgtatna

SEQ ID NO: 93244 - DNA, 316 bp, Homo sapiens
gagcttctacctggccctctacaagcagatgagcttcctggagaagcgaggctgcccgcgcacggcgctggagtactgcaagctcatcctgaggtgagtgtctgctcagggccaagcccgtccacgctccctgtcctggctgcaggcccactctcagcctgacgatgcccctgttcccctttgctctgctctctgtgctgcctccggaagtctcgagccggatgaggaccccctctgcatgctgctgctcatcgaccacctggccttgcgggcccggaactacgagtacctgatccgcctcttccaggagtgggag

SEQ ID NO: 93245 - DNA, 921 bp, Homo sapiens
gagtctcccatgtgtaacaggtacgaggatgaaatcaacaagcacactgctgcagagaacgagtttgtggtgctcaagaaggatgtggatgcagcatacatgggccggatggatctgcatggcaaagtgggcaccttgacccaggagattgacttcctgcagcaactctatgaaatggagctgagccaagtgcagacccacgtgtctaacaccaatgtggtgctgtccatggacaacaaccgcaacctggacctggacagcatcatcgccgaggtcaaggcccagtatgagctgattgcccagaggagccgggctgaggccgaggcctggtaccagaccaagtatgaggagctgcaggtgactgctgggaagcatggggacaacctgcgggacaccaagaacgagattgctgagctcacccgcactatccagaggcttcagggggaggctgatgcagccaagaagcagtgtcagcagctgcagacggccattgcaggaagcggagcagcgtggggagctggcactcaaggatgctcagaagaagctaggggatctggatgtggccctgacaccaggccaaggaggacctgacacggctgctgcgtgactaccaggagctgatgaatgtcaagcttggccctggacgtggagattgccacctaccgcaagcttctggagagcgaggagagcaggatgtctggagaatgtcccagtggagtcagcatttctgtgactggaaatccaccactgtgtgcggaggtggcgcagccagcttaggaggtggcatctaccagagatgggaatgagggggcaccaaagggtgatacagaaacaaatgatgggcataggaaccgacagggagggcagaatccgaggcaccacaacactgagaagacacaagggcaagagtcagcagaagta

SEQ ID NO: 93246 - DNA, 812 bp, Homo sapiens
cctcggcctcccaaggtgctgggattacagatgtgagccaccgcgcctgccctggctaaaatttctttgcaaagaattatttaaaatgttcagttatccgggcacgatggtgcatgcctgtagtcccagctattctggaggctaaggtggaaggatcacttgagcccaggagtttgagtctagtctgggcaacatactgataccttttcatttaaaaaaaattttaatagtaataagaatgttcagtcaatatcaatagaattaggaagaatttctatttccttccttcattaattcaacaaatatttattgagcaaacatctgtgtgtcgtctggcgctgttgcacaggtcaaactggcttcttaagaatgaaatcctaagtgtgaggaagaaattgcattgtatgtgtggtctgactgcagaaaacctaaaataagtaaactgctgccatgatgaaaagtcaaggagtaagttggcttttccatgttagtaagacaagtgaaaaggcatgtttcagtcacgatgtaatatttcctaaaattttgaagctatggggagaaaggtttgggaggaatttcatagggaaaagaaaatgtggggagggggaatgtaagcaaacaatacttagtacattttacaaaattaaagtcactttgtaggtatataaaaagttttaaaagttggtttattaatgagagtagtgtattacatttcttttcaagcagtagtttaaatattaaccagtttacttttttttaaagtcaatttacttttccagcctggacaacatggtgaaacctcgtatctacaa

SEQ ID NO: 93247 - DNA, 364 bp, Homo sapiens
cataaacacacagcaaaatcagcaaacaaagctaagtagcatttaggcggggagcagtggctcacgcctgtaatcccagcactctgggagcccgagtcgggtggatcacttgaggtcaagagttcgagaccagcctggccaacatggtgaaactgcatctctactaaaaacacaaaaattagccagggtgcggtggtcgtgcacctatagtcccagctacccggaggccgaggcaggagactctcttgaacccggcaggtggaggttgcagtcagccgaaatcatgctcctgggtgatagacagaggctgtctcaaaaaaaaaaaagaaaaaagaaaaacagctaagtagcatttagatgaaac

SEQ ID NO: 93248 - DNA, 432 bp, Homo sapiens
gaacacagaagtctgttgccctattcaaaccaaacgtctcgctgaaagaattatgtttatagtggaaaatgggcaggctatttgttcctttaaatcagtggtctccacatatcgctttctgaatcagctaaaaaaatttttaaaagtattcccatggatgtatacttattaattatactcatgtactattgtactaatatatacaatatgaaacatacacaaagaaaagaaaaatttaaagaatgagaaaacacaaataaatacaaattctaatgctgtcttcctggacctagctataccacctcacaaaatgacctatggtgtacaaacccctaaggtattagcctctataacaggagtcctttacagcccccaatggctgtggaatctggaagtagaccagattatcagtgagtagtatactttgtattg

SEQ ID NO: 93249 - DNA, 346 bp, Homo sapiens
agacagagtcttgctctgtcactcaggctggagtgcagtggcaggatctcagctcattgcaacctgggaggcggaggttgcattgagctgagatcatgccactgcacaccagcctaggtgaaagagcgaaactccgtctcaaaaaaaaataaataaaataaaaatacttcatccctttcaaaaagcaatttggtgatattatcaagatcccaagggctgggcgtggtggctcatgcctggaatcctagcactttgggaggctgaagcgagaggatcacttgagtccaggaatctgagaccaacctgtgcaacatagtgagactgtgtctctacagaaaaaaaaaga

SEQ ID NO: 93250 - DNA, 558 bp, Homo sapiens
cagtattgttttataattttaaggaaatcatgtttgtttcactgctttgtttttttttttagctgttgccttgtcactgtcacagctaacaagacttactacatacttgatattctgaagtactgtggggctgtcctctgtatactgacattaaataaacgtgtgtgagtgaactgtaaatgtagataattttcagtagtcattttcacatctaagctttaaaaatcccagtgaaccaaaaccagaaaagtttttaaatgctgtaaaattaaggaccttgttaatgtttatagaacagccagccaccggaattgctccctcttactaaagctgactgtttctcatagttggcagcgtactcgatgaaatgttctgcgtctcagatactgttttatgtggtcctcctctgtgccaactccagtccgggagaaggactgttgattggcgtttcggctgagctgtgtagaggcttctgtttaatgagaatgcagacattctgaagtcgtcctgggccacgagctggcttttgttacatggactcactatcccggatgctgg

SEQ ID NO: 93251 - DNA, 435 bp, Homo sapiens
aaagtgagacacaaagtcagtgtcagcccagttgatccacaaaacatgaatggggtgcgtgtggttttgagcccagacgagccttccagtcactgctctgcaccaactccatgtcagaccctgtctcccgggtggatgggtgaggccaagccagcccccagcctggagtgagtttcctgatgcatcccaattcttaagtccccagcgtctagactccggttgtcccccagcaagacccatggcttggggaacaaacccatttcctgaatgccttactacatggggagcaccatctgagactcttacaggcagaattgtacggcagtcagacagacctgggtttgagttctggtcctgccacttactagccatgtgacttgagtaagtttacacttccctgagcttcagtttcctcatctgtaggatggggataac

SEQ ID NO: 93252 - DNA, 436 bp, Homo sapiens
ggagcacatcagatgggaactgaggggacccaggagtgtgatttctttatagctaataagccctggctttggagccagacagcgctggatttgaatcctggctctggtacatattagcttaggtgatgaagggtaagttacttcaactttccttgcctctgttattcacattttcaagtctgctatataagattaagatgagaaataaagcatataaaatgcctgactcattgaaagtgttctacaagtggtagttacgaccatgatgtaactcattttacttagcctttctttaattgtatgtacttccctgaaaggccatgaataaagttcagatttggatattgaatcatattttccacagacttcaattcaggtttcagaacatattcccaaagtaaagaaaatgctgccactaagactagataaaacccac

SEQ ID NO: 93253 - DNA, 458 bp, Homo sapiens
cctctcctaccagcttaggcagaggacttagttactatttccaatagatgggagccaaggaaaagacaagcatctgtgatgtcatgtctcccccaaacgggtagctgcctcaccagcctccattagagacatcccccagagtaagaaataagaaataatcatgagtagaatgagaaaaaaatgcagcttcctttatctgagaaaaacaatagtagctcaatgctgtggcctaaagggctttgaaaataatgcaatttctgataaaaataaatgccattattcttgcttattgtcactgttttagtcaaataagattttagcaagcatatttcaaattgttctaaatctaagtaaattggtaattaaatgctatcattagaaagtattttaatatcagaaaaattggaccataagaaagttagtttacccttgtattcatatatacatgtgctttgtgc

SEQ ID NO: 93254 - DNA, 189 bp, Homo sapiens
gctcctgcctttcggccacttcagcaggtccagctcctgcctgccagtggcctctttaggcccagctcattcctcacagcggcctttccaggccccgtttttcccttccggcagcctcttggcctctaatttgtttatcttttgtgtataaatcccaaaatatggaattttggaatatttccaccatta

SEQ ID NO: 93255 - DNA, 535 bp, Homo sapiens
agaagaaaataattacgaagtatgcaaacaaacttaaaaggaaaaaaatgtattgctcacacctgaaccccacacagcatacagctgctttattagaatggcattcaagtaggaacgtggaagaagctgtgtccatagtggtcgtgtgatgactccagctcttaagcaaaagcttcacataatgacagtcagaatttgcccagtcatggttcaattttatactgttcgtattttttttaactagttttaaagtctttattattaaaattcctgaaggaaaaatactattgagagttggaaatgatgctgtatctacaaattaaatcataatccctaattaaaggatttcatatatacagcttatgttttagagtttcacattgtatgaaagttgccatgtgtgttatctatgtatttactttctgccatcctaccgtcattattcttgcagatcaggaaattttacgtaaattagagaaggagaaaatcctggtgttcacgccatcccggcgagtccaggggaggagagtggtgt

SEQ ID NO: 93256 - DNA, 8429 bp, Homo sapiens
ccaggcttgataactaagactcacagacagctctgcaggtctccctgtttagagcctcacatactcaagcgcaatgaaattttgcaagactttaaacctgaagagtcccagactacatccaaggaagcaaagaaaccacctgatgtggtgcgagaataccaaacaaaactggagtttgcacttaagttaggttattctgaagaacaggttcagcttgtactaaacaaacttggtactgatgctttaatcaatgatattttgggagaacttgtcaaacttggaaataaaagtgaggctgatcaaacggttagtacaattaacactataacacgggaaacttcttccctggaatctcagaggtctgaatctccaatgcaagagattgtaacagatgatggtgaaaatctgagaccaatagttattgatggcagcaatgtggcaatgagccatggaaacaaagaagtattttcctgcagaggaataaaattggcagtggattggtttttggaaagaggccacaaagacattacagtttttgttcctgcttggaggaaagagcaatcccgacctgatgctctcattacagatcaggaaattttacgtaaattagagaaggagaaaatcctggtgttcacgccatcccggcgagtccaggggaggagagtggtgtgctatgacgacaggttcatcgtgaagctggcttttgagtcggacggtatcattgtgtccaatgataactacagggacttggctaatgagaagccagaatggaagaagttcatagatgaacgattattaatgtattcatttgtcaatgacaagttcatgccccctgatgaccctcttggcagacatggccccagtctggataattttctgaggaagaaacctattgttcctgaacacaaaaagcagccttgtccatatggaaagaagtgtacctatggacacaagtgcaaatattaccatcccgaaaggggcagtcagccacagcggtcagtggctgatgaactccgtgccatgtctagaaatacggcagccaaaactgcaaacgaaggaggactggtgaaaagcaacagtgttccttgtagcaccaaggctgatagcacttctgatgtcaaacgaggtgctccaaagaggcaatcagatccaagcataaggacacaagtctaccaagacctagaagaaaagcttcccaccaaaaacaaattggaaaccaggtctgtaccttccttagttagcatcccagctacttctactgcaaaaccccaaagcactacatctttaagcaatggccttccatctggagttcatttcccacctcaggatcaaagaccacagggacaatatccttcaatgatgatggcaaccaaaaatcatggaacgccaatgccttatgaacagtatccaaaatgtgactcacctgtcgacatcggatattattccatgttgaatgcatactcaaatctgagtctctcaggcccacgaagccctgaaaggcgtttctccttagacacagattatagaataagttccgtagcttctgactgcagcagtgaagggagcatgagctgtgggagcagtgactcctacgtgggttacaatgaccggtcctatgtcagctcccccgacccacagctagaggagaatttgaagtgtcaacacatgcaccctcacagccgccttaatcctcaaccgttcctgcagaatttccacgaccccttaaccagagggcaaagttacagtcacgaagaaccaaagttccatcacaagcctcctcttccgcacctggctctgcacctgccgcactccgctgtgggcgcccggtccagctgtcctggcgactacccctctcctccaagttcagcacactctaaggcaccacacctagggaggtccttggtggccacgagaatagacagcatctctgactctcgactttatgacagttctccttcacgacaaagaaagccttattcccgccaggaaggcctgggaagctgggagaggccaggctatgggatcgacgcctatgggtaccggcagacttattccttgcccgataactccacacagccgtgttatgagcagttcaccttccagagcctccctgagcaacaggagccagcctggcggatcccatactgtggaatgccgcaagatcccccgaggtatcaagacaaccgagaaaagatttatatcaatttgtgcaacatcttcccccctgaccttgtgagaattgtcatgaaaaggaatcctcacatgacagacgcccagcagctcgccgcagccattttagtggagaaatcccagctgggttattgaaagatgatgcatctttgtggtgtttagtagttttttgttcagctcaaatgctgagggaggtttgctacaatagcacatgtgatctccttctcagcaaggaggttatatagtatccatttatgtgaaatactgtatcatggaatctgtatgtatagccccacatggtggaagtatcacgggattgctttacatttaaactttttttttttaacatttcctttttaaagctatatccttggctggaaatttttccagtttgatttaatagatgtatctgtgatctttgatattaatctttggtgcatcaggggtttatatgcagcactttttatccttgttttgtgttttattaacttggtgtttgtctatcaattgcaagcaattacaataccttcagaatgtgggacatttgactagacctagcaaactgttttttcgagccaagcttagttagactcttttacagctttttaagttatttttatttggggaaagtgggcttctttgtgctataatcattatttatagaaacaaagttatactacagcactgactttatattttaaacagaatgtaagttaccagttttatgttgaaatgtgttacagtatatatatattagaatgatttacaatatggcacttttcgatgtgttatttttgtttggatttttttttctgttaagaaattagttaatttaatatggtcaatttaaaagaaagcagatgcaatcaatggaaaaatgtttccattttttaaaaatgaataaggcaaaagctgtaactgttacaggttagagctttgttatccagctatgatgtgcttcttgacagtagaagtggaattgaattcctagatttccattaacctgtatttttaatatgtctgtctttttgttttggggcacaacaatactggataaaataaccctttcacagcacttgcctgtttttaatgaatctaattattcacaatgcaacttttatatttaacatactctttagctttcctgctatttatcaaggctggcctgaggtgggtttatgtgttgaggttatgcaacatttcttgatactgcactatagagaaatggtgatggaggagttgtaaatggtaacttaaaatttttgtaagatattgtatattttccattttcctgaaggtagttttcttgggggggcctgttatattattaaggccagactcttgccacaaatagtgtagttttagatacagactaaggtctgttctagtattagtaagggatatttctggtttcaaagtcatgggttttgctagtggtgaatacatttctgcggagtagaagatagattttgcagtcagtggcagacagttgtgtgattgacatcacttgactgttgcgtccaggttttgaattgtacttcacgtaacagatgcattcagatctttttctgtagtctgcttagatgccctggctattctgattatcctacatgctacagtttgaagtgaagccctgaaaaaccagaaagtaccttttactgttgatacaaattgtatctttttaactataagaactattttgatttgtagatctagttaaaacacaagtatgtaactatgattagacttttgggcaacattttatcccttatttaaatacaaatttttaaagtaaaattgaggtctagaatagattagaaaataaaaataacaatttagataaatagaaatgtctgtcttagttttatataatatattaaaacacagtaaataaatttattggcattttctttctcctaaaacttacctagtgtgaacttaaaataaaggtaaaatgctgcctgaaaataatgtccaagcacctttgactaggataacattttcactacttgtgtgacactgtgtgttgcacgaagtaggatttgggtatacagtaaatgcttctaaaaggcattgtgcatattgacataaccaataatctgaaccgtgttcagcaaacttaattcaggaaagtggtattctacacaattattgctgttgtgtttgaaatgagtgtggcactcatctgtatccagaaataatatgggtgaggccacacaacccattctgagtggtgtctgtctgaaagcaaccctactcgcatgtgaaattgttctccttgatttggtcactataaagcaagtttaaatgtagaggctaactcagtgccaaaaacagggttacaaatgtgtagtatcttttattttagtcatattctaagacttctttttagtatgaaatcacttttaaattatacatgtaggttttgcttccattttcttcattttaccattttaattatttgaacattcgccaaattttacatttatttaaatgagatcttaggtgagatgtgtgtgacactttgaatttgaccttcttgtgttattagctgactatttgtcattgcctcatggattttaaattatgggaaaatagtgtagccagctgccacctctactgaagtgagtagctctgaactacccacactaaatccttcagtgtaattaattatgagtttaaaaatagcagttttcttatgtgaagaggacagtttgtcccctttttttgaagcaccgatgttgcgttcagagctgtagaatgagataattggcagactttaggtacagcaaattcttacttatctaaagcaataagtcaaaggagtccatcattaaattaaatccatagctgatcacaagccttcattttagccaaaactttctctctaaccaaatcttttaccagacttgctaataaataaccagagagatgtgttaataagtgaagttgccagaaatggtcaactgatcggaaaaaaaaggattcagactggagtattttgcccctgaataattgacagttgactgtgctttacacagtaactagccagtctgttgtctctgtgtcttagtccagagggaatagtacccaattggccaaatactggcccttagtatctcctcctttcttgcatgggatacagacgttttcagtcttgtttttatgatctctctctatatcctgataagagtttgtcattgacttacacatttggaagaaatgcacaccagtgtaatatatttgatactggtggaaacttgaactttgtgtttttatgaaaattcatttatgagaatatgtaatataactgaagagtattttatgtatatctatatacacaaatatgtatttgttatgaggtattaaaaacaggggttggggggagtgcttctgatggctaacttttctctaattaaactatgtttctttgagttgtgaacgaccgagtctggggtctggacggccaatgataagatttagaaccacttggatggaaagcagttcttcactggttttattcttggtattttcaaagaattattttgatatttttaatagaatgtgtaattttaaaatacacaaaaaacttaaagtagtattgattatacaaataattatttaacatgtcttatggatgtatctatatgtatatagacagtaatatatttataaaacaaatatactttgcttatgttatagctcttagtttgtgacaggtgggaggatggctctgggtgtgtgtgtgtgtgtgtgtgtgtgtgtgtgtgtgtgtgtgtgttttgaaaactctcaagctgttttccctctgatttacaatggtatttactttaaagtatgtttggttttcattattctttttgctctccaacttccttattcaagataaaataagacatacagttttctggccattctgttggtgtgtggtgcacccattttattgtcatctaactcctggagaattcccacgtgacctgaaatcaaacagattctggctggacatatgcttatgttccaaatatattaaagatgttaattcagctaacagttaagtttccaaggtatacaccaacaaataaaatgaggtattaaaaagagatggattacacacatgcattagaataagagaaaacagtagtgttaataaaagtaaagaaacatacactatcttagccccctagggcaggggttgactttttctgtaaaggatcagatagtaaataatacaggaatcatatggacttcaaatgccattgtaaaaactactcagctctgcctttagagcataagaacagccacagataacatgtaaattagtgtggctgtgttccaataaaactttatttacagaaacgggaagccggtcagattgggcctgtgggccataatttgctgatctcaagcagtaaatcctggtatatgttaatagaagaaatcataattgcatttcagttgacattaaaagaaaatctggtagtttttgatgtccttcaaaagaggattgttagacattgatgttaaagcatcttaattcatttgagttttcttacctgtttacacccattatttattagagatatttcttgtgtttaaccacaaaaaaaagcactctgttaaaatgttttaatatgtattgaatttctttcataaacttttcatttctgttgataaatgggaatcccttaccaaccttttgttttttaaaagtctcatagaccaaaaaaaatctgttgcagcatttaattagccacagatacattttggctgcatttaccagttacatttttccattggttttggcttctaataaataacatatctgccattctttaaaaatgattttaaagaagataaatatattgtaatttcacatgctatagctttattctgtaagattaaaaattgtgactagtataattgtagctataatgtgagtggcatgttacaatgtaactctttatgagaaataaaatgtatctctgctttgtctgtccagatctttaggatttttagatgccttgggactgtccttggtgaatgatattcttcatatgatcatatgtaattttgaattcgttggaagtacacgctgctgagcatgtttattcacagtgctttataccgggtgttgcatcagtaatcattttcataagaacatttaaacagcatgaacatcatcatccacttaaatagttaaactttcttttaaaattggaatgcaactgtaggttttaacaatgtttattgttttttaagtggttactttgtttttccttaatactttctgttaacttaattattactcctgttgcagtgttactgttatgtattagaagtggcttttccccctaagatccttagtcttttaaagacaatttaaggtattggccatttggcagtagaaaatgtgcatgttttaacttggttttataaaatctgtaatgtttcacttcttgaaccatgtaccaaatttgccaattttctgtccaagtgtttcagatgaataacaaaacgctgttcattgaagctttcgccacctttcttaaagcagcgtatgttccaagggaaaaaggcattgaaaagcaatcgtttgtttttatgaagaataggtgttcagattccttcagtttttttgaaattagaaatttcttaccttatgtgaaatattcacaaacgtgcacacttctgcagagacaaagcatttcactgcacgtgtaccaggttattgattttatcttttcctttcagggttttgtcctcccaaaccagagtcatatgctgctagtagaattttttatttgatcctgcgaacttttcttataggaaaagtaaggcaaaggatgtgtagtgcaaccatctgataaactagtgtgattgtatttatcctctgttctgtgtatttctgtaatggaatctttacaattcccaaaacggtattttagacctactggaaatctgtatcgaaacagctatgtgattctgccactgagaaaaaaaaattttttaattcgtttttcttatgctggtttgtttttctttaatgaagaaattgatctcatatggcatcatagatgctaaataaataaaagcatcatacttctctagtttgcctgcattcagtggctaacattatgagcattgtgtaagataaacacatggtcagtatcaatgtaaatgttagagccatgattaattcctatgaaaattgaaattaaatgtcaaagacaactagacat

SEQ ID NO: 93257 - DNA, 441 bp, Homo sapiens
gaggtgaggggggcgagtcctgtcaccaaaggggctggactttctttcctggcaggctcagccgcacctgggatgtggaaaccttggcgggggcgagcacccaggtcattttcacaagcagcaaaacaaaaacaaaacttcagctggtttccaatcactcaccatgctgcttctttataaatcattttaaagtgatttcactaataaaattcagcatgtacagcgttttatttttaacgtgcacattttaaagcataatgttacatacattatggaaaggtgcataatgagagaaatcatttccataatatatcaacttcctggctaaaaattctttggataaaaatccaatatttatttgatatcaatggacacctatgtcaatttggttttcactgagggaccttagagggaaactttgaagtgggaagatggtctgtg

SEQ ID NO: 93258 - DNA, 335 bp, Homo sapiens
tatacatgttatctgcagatgctggaaggaagaaaggaaggaagactaaaggaaagaaggaaggaagacaaaaggaaggaaggcagggaggaaggaaaaaacaaaggaagctttaaataaaacttaattaactttatttaaagaactgtaaataaagcttaaataatgttatataaataacttttaataaattttaaataaagttttaaatgaaaaaagaacattgaaattttgctcaacttccctgtaagtcagtgtaaggaaaaaaaggaaaaaaaatcctttaaaaatggctccaaaggacaaaagtggaaacctggtgttattcagaatat

SEQ ID NO: 93259 - DNA, 257 bp, Homo sapiens
aaggggagaaggggtcacagcactggtgtggataggggtgagagatgctggcacccagatgccgtgatctgccatgggcagggccggatgacaagcagggtgtgctgagtctccagaaagatggagaccctgcccaaggtgaggtggagaggccaaggctggggaactgcagcggggagtccatcgtacagatgttatgtgtgaaccacaggagtaactgagggggagccagagacaacatctgccctcgccctggg

SEQ ID NO: 93260 - DNA, 179 bp, Homo sapiens
cctcccaaagtgctggggttacaggtgtgagccaccacatctggccttacagccttcttctgtgtgtttatgtgcatatatgtagccatagggaaaaaaatcaaaatcctttggtgttctttcttattttttcaaatatttcacctgccccattctctttcctttctccttctagtact

SEQ ID NO: 93261 - DNA, 258 bp, Homo sapiens
ccaccattcctgggtttgaatcccagctctgcactaactcattggttaaatgagtcagtatacatatgaagcatttataaaagacagtgtctgggacatagcaaaaactgtaaatgatattttcattataccactagtagtagtactatttctttcactttgagttgtctgttcataccctttgtccatttttctatcttacaagttcctttttttttttctgagatggagcctcgctctgtcacccaggttggagtg

SEQ ID NO: 93262 - DNA, 1058 bp, Homo sapiens
aaccaatgttttaagatggaaataattgtctgtttatgtgtatatgtttgcttttaaaattttacacttttagacaaattattatttttttccgtgtcataaagaaatttcattttaatcctcattcctctaaaagaatttttatggttttatcagcatgatacttacaaagagcatatccccctttagacaaattattttaggcagccaagtttagtttatttgggtttcatgctataaattatgctaatttatgaaggttatttcttgttggatgcttgtagtattcatataatatttaaatgcaaaagagaatattaatataaagcattatcaattaaattttattcaacctgataatgttttctgtgatacatgatcatcgtaggtgtataactaattttgcattaccatttatgagtgatatagttgtgttctttttaaagtgtgtatgcaattagtagtggttatattcatttcgtgaaatctctttgaaggtcctttgttttaggagtgtaagtaattttcattataatatattcataaatttttaaatctcatttccatatgaaggtaaagatggggtcattcttagaatgaaataactctattcagaaggacgcagtcaaaagctaggaattcatttgttatccctctgtagttgttaggacaggagcactaatctggccaactaacctttaaaagaacatgcaaagtcaaagatgtcaggttgtaccagtaaatattcaccggcaaactttttatatcaaagactggaactttcgaagatgctcctgggacttagtgtactctaacatctattaatccctggtaccttaggtgacttgtcatagaagtgctacatttacaagtagtatgcaaggaggcccaagaggacaaattcagttaaaggtcaaggaagcaattaacgttctctacttttccctaaagaacttccacagcaaatgttgccctccccctgcatccccaatcttaccaaggcaagtgcatatagtgaaatggaagttaaagttcaaataaaacatgtttccaatatt

SEQ ID NO: 93263 - DNA, 360 bp, Homo sapiens
tagatagaattcacatgctgtgagattcaccattttaaagaataccaaatcagtggtttttatttattcacaaagttgttaacattaaaatttgacctttggaaatataaggaaatattttagaaatctgtagggagtatgaagggtcattttttattttaaattgtagaggtggtagaatgacgtttacttcctggatctgtttttggtcatggctgcagttttgtttggagtgtacatcttctgggtgttctgctcagggagtttatttagtgttgctttcagtgaaattgccatcccagtcctgtctgaatctataactgccacactgtatggtcactcttagagacatgaatggat

SEQ ID NO: 93264 - DNA, 339 bp, Homo sapiens
gagcatagataacttcttcacagcaatatcagttgatgaaaatgcacagaaagtaagaggatattattaacaaatttcaaaaagtactgagatcccaccaagttgtttctccttgcatttgtgtgtgtgtttgattctggtaagtcctaatctacagttttttttaagagcagaagccagcagttgcctaaggtcgatgtgttagggtgtttttggcacaggcctagtttccttgtcttttcgtacaatttgaagtaatagtatcttggtaaatggaccttttatggaagttaaaagcaaatgtataaattatcctttgaaattgttacatattgagag

SEQ ID NO: 93265 - DNA, 83 bp, Homo sapiens
gggaattaagaagagattttattttttgctataatcttctctgttagaagaccgttcctactggtaggagtacaaagtggatc

SEQ ID NO: 93266 - DNA, 729 bp, Homo sapiens
ggccactatgcagggctgcagggactgctgtgcttcccttgctttccatgttattgctctgaagataatcatctcacttaatccagatgagcacagtggtgattgtaatcacatggtctaaaggaaaatacatttactgcagaagtgaatcagttagtttgctaattaagttagttttataagtttattggttttattttttcttagctgaaatcgtgaatttgaaattttatgattatttttcatggttcaataataggaaaaactgttgaaatattaagtggagaaaaattgttaagcttatttaaattcttctatccaaataatacatgcatgtggtttaaagagccatgtagcagtaaaaggcttagaaggtaaaatagcagtccctgccctaccccgtttcacagtctcccttcccagaaataactacttcctgttcttctcactgtaattctagttatttgtatttcttcattttcaaaataaaaaccttctatcttttgagtcatttattttagacatgtcacttggttctaatttaaaaactttgactttattaaaacaaattaaattcaccctgtcttatggtgctgagtctgttggttctaaattatgataaatgagcatttaattattttttattacctttcctctctgtcttaccacattcttcttcctttagagttatattacaatttttggttaaatacaaaatgagtttttaca

SEQ ID NO: 93267 - DNA, 341 bp, Homo sapiens
agattaaatgagatcacatatgtaaagggcatttagggtaatctgaagtttctctgcagtttctgcatcttggcctaggatttttaatcccttaggaaaattctgtctatcttctgggtagtttagggttagtatggctcagagccctaccctggtcctcttgtcctgacattaattgagttagaaataaggtagtgctcaatatcatgctatataccactgctcttggcacccttaaatccagccatactcaatacccccaatattcccatttgattcactaatgactcaagctgtcaagtacagtagaaaaggtaactttttttttttttttttttttt

SEQ ID NO: 93268 - DNA, 375 bp, Homo sapiens
caggaatgagccactgcacccagccttgagtggaatattatattttcagatatgaccagttttaaagaactaaagttgactatctggggaactcgcccccaatatttcaacgtaggttctttctattttccctaagcattggctggctgagaaaaagaaagagtacaaagagaggaattttacagctaggcttccgggggtgacatcacatatcagtaggaccataatgcccccctgagccacaaaaccagcaggttttattaaggattttaaaaggggaggggttgtacaaacagggagtaggtcacaaagatcacatgcttcaaagggcaaaaagagaacaaagatcataagcttctaaggccaataaagatc

SEQ ID NO: 93269 - DNA, 524 bp, Homo sapiens
ctaacagacacatccaaccttgtctttcttccaaggtgagaatcaccttttggccaatgcaacttgcttcctccttattttttggactcagccacctcaggaagcctcaagtctggcatgatagtaattttccctagattttctcccacaaaattctattctcaagcagatgtaagatctataataaatacctataaaattgctgtgaaagaaactaatcaaccattgcatttttttatgtgaacttttgtaatggagaaaaagttaatcaagaataaagattcaagcccaggtagtgtgcatctatagttgcagctactcaggaggctgaggcaagagaatctcttgagcccacgagttcagggccagcctgggcaacataatgagacccccacctcttgaagaaaaaaaatcaagattcaaatacaaagaacagacattagtagtcaaagtgtgataaacttcaaaaaggctatttaaaaaattagttacttttgattgacaaatcataattatatacattt

SEQ ID NO: 93270 - DNA, 208 bp, Homo sapiens
catccgcatagtatttacatcatgggtataggcaagtgctacaaatcaggacttttccttggggatggatgtttggagctagtttaccagcacaccagtgggtaaaagtgaacaaatacttttttgatcccacagaatcttaaaaaatactttacttcgaaaatgtctctactaagtaatcatatatatatatatatatgtatatata

SEQ ID NO: 93271 - DNA, 475 bp, Homo sapiens
gacctggagcagcaagaactcccactcattgctggtgagaatgtgacgaggtacagccaccctgaaaagcggttggcagttccttccgaagctaagtatactcttaccatacaattcagcaatcacactccttggtatttacccaaatgatttgaaaacttatgtccacacaaaaaccaccccacatatatttatagcagcctttttttccttaaagaccagtgcgatagtattagcagctttattcgtaattggcaaaaactggaagcaattaagatgttcctcagtaggtgaacaaataaaatgtggtatatctggacaatggaatactagtcagtgataaagaggggaaagctatgaacccatgcaaagaaataagttaatcttaaatacatattgcatagtaaaaagcctgacaaagctacctactctatgactccatttacctgacattccggaaaaagcaaaatagatt

SEQ ID NO: 93272 - DNA, 356 bp, Homo sapiens
taacatttgaattattaaaaaagaaaaaaaagctgtagttttataatagaaaatatataagatttttaaaatccaggaacatcaataacaataatactaaataaagatcttttttgaggaggtaagcccacaatatttattgtagctaataggtaggttaacagagtaaaataggagaacttaatttttctaatagtagaaccaagtcatgttgaaagtgacaggaggaatcggaaaagtggaaaagtgtagtggaaggtgcccaacatgtgaagtcaagacaagagcacctctttcatagtttagctgtgtgacctagggtatttaactttgcctcagttttgtcagctttaaga

SEQ ID NO: 93273 - DNA, 434 bp, Homo sapiens
gtagatttgttcatattagcttctttatattttcagaggaagcagccataacactttggatagaacacatggcactttggatagaacacgtaacactttggaagactcctttggtgtcttcatttttgggggggcaggaaagacagtctctgaggatgaggatggtaccactacccacaggacggaaggaaaggtaaaaggaagattgaatcactcttcaacttccttctggagcccagccctttccacctgctcaggggctgacttctccggtatcatcagccattcctttgtttcaagagtcatggaccgtatactgaagatctgtgcagtttaggatatgtaaattatatctcagtaaagtattagaacacaaatacacacaaaagcctttctgtctttctcttcctctcttcagccagatttgacagaga

SEQ ID NO: 93274 - DNA, 433 bp, Homo sapiens
cgccccccgggttcaagcgattctcctgcctcagccccctgagtaggtgggattgcaggcttgtgccaccatgcccagctaatttttgtatttttagtagagatggggtttcaccatgttggtcaggctggtcccgaactcctgacctcaagtgaactgcccccgcctcggcctcccacagtgctgggattacagatgtgagccaccacacccagtctcaaagaactattcttacctgttttctccaatcaactgatttattatctcctgtaaccatatcatcataacttaaccagagggaacggtgagctttttgacctgttcctcattggtagctcgcccttcaagatatatggaaggacattctggaaaaccttttgttatgaaaattgtgtcctgttatttgaacatatttcagtggagggcattgtct

SEQ ID NO: 93275 - DNA, 348 bp, Homo sapiens
ataagcccaccttgggtttgatctttggcctaaggctatttttaatttgccagatctttgccatctgtaaacccagcaagccctggtttctttgtatttcctccaaatttttcttgaaaattaaactattctttttaaaatcatgtatctgtatttttgttcttaccatatgtagttataagccaccagttgacactttcaacattcttccgggaactctccttagctaaatccactaggccattaggtttattttctgctttccacatcaccataggcaatactggtgttaaactttccatcattgcagaacatgggtccctttcctccagcttttaataccatttc

SEQ ID NO: 93276 - DNA, 685 bp, Homo sapiens
gtttaaaagttttgtattatgtcatacaaactgtcttcacatacaagtgcattaaaaaaattatccccccctcctcctccccaaacatcacagtagaccaattcttgctaatatatgacaaagttaaaacatatgtcccctctgaattctaaacagctaattctagacactaacatctggatcttataatttaccggtctggtatggacatgaacagttccagtgcctttcaacttatccctgaatttttctcttctcaaagttctaggcagtaattttaatgccctcaaattagataaagctgattacttagagcttataaattagctacactttatgacactaagaatagagctatgacttatgcatatcatacctgtcaagctacctagcaccacgaatagaactaatattaatggatggactaatacaaggatctaatatatgacagtgatagtcttaaaaacaccgatttgttattttccttatatataatccaaattcctttctatccttctggcaatgtttctactgcctgactaccttaaataactatatagtgtcaatttcttgcttgggccaggtggtggctcatgcctgtaatcccagcatattgggaggattgcttgagcctaggagttcgagatcagcctgggcaacatagtgaaacctcatctctatttaa

SEQ ID NO: 93277 - DNA, 864 bp, Homo sapiens
gtttgttttgcattattatatgcctagaactgttagattattttccttaagcaaatacagtcagagtaaatttttggagatgtggcttaatagccagacgaaaagccataaacctaaaattcctagtgtcagtgtctttgctctttattaagtctctagacaatggatacagttttgtcatgaaggcttattgggcagtaggagtattgtctcttaagacacagagatgaagaacttaaaataattaacttctctaactagaattactgtatgctcaatgataattattaagaatattaagcatttaagagaacaaaatttatatctgtccctcgaaaccactattaacatcttatgtgctttttttaaaacaagaacgttttataatgttatacatacaatgtaatctgcttatttgtaactgtgtcattctacaaaattaaatattttctgatcttggttttaatgcataaaaaaatatccaatagatgtaccttatgatggtggttttctaactgtggttcacaatgcttcaatgagatgtgaaatcagttcatactttgtttttgtttttaaatggaatattatataaaagaaaatgactgtgtttaagtgtattaaggctaaattctgttccggggagatctgattttatttatgtaaacaccatgatatataatgtatttctaactgtaggccatgatcacaacagttgtttgcaagccactgccttaaattaactcttatccttttgttcaacatgcagattgttttcaatgaacattcatgtatataaatcattgtatataactcatatattgtcagggtaaatttctaaatgtgaatcacttggtcaaaagataa

SEQ ID NO: 93278 - DNA, 1971 bp, Homo sapiens
actgattttcttagataatataattaaacagaagcgtgtaacagattaaacattatgagagagaaaaactttattgatcaaacatttggcttccaagaaaagtacctgacctagctcaatattaggtaacattatgaagtatttcctgggcatgataatgacattgtggttatatgataggtgaattatttagggtcgaagtgtcaaatcagtgtctttgtggagggataaagctttgtggagggataggggaaaatgttcgacaattgttgaatctaaatagaaggaattcacatgtttattttaacattctatcaactttttggtatactcttaacaaaaagaaaaaaaacaatgcctgacttagatgtttatatgggtgactcaagctatcaagtaatggataactcctgtgccatataaacagttccaatacactaacaaaaacttcctaatttacttgaggacattaacaaaaacctcagaagacatacctgaaattatgaatcttttgcatcagtgtgatgtctccacttttatttctgattttatttatttgagtcttctagttttttcttagtctagctaaatgtttgttaacattgtttttaccttttcaaaaactaacaatttagttgatttcttcctgtttttctattttttatttctgctctaatttttattctttccttttttctgctaactttgggcttagttttgttcttttttttctagttccttgagatgtaaagttgagttgcttatttgagatctttcttcctttaaaaataggcaattatcattagaaacttccctcttagtcctgattttgcttcatcctgtaagtgttcatttgttgtgtttttgtcttttttaaaattttccttgatttcatctttgatccactggttgttttaagagtgtgttgttaattcccacataattgtgattttcccagttttccttctgttactgatttctaattttagtctattgtgcttgggaaaaaaaggttggtatcatttcagtcttcttaaatttgttcagacttgttttatgacttaatatgtgatctatcctggagaatgttctatgtgcagttgagaagactgtgtattctgcaactgttaggtggaatattcagtatatgtgtgttctgttcattattgaaaatggggtactgacatcttctactgtattgctaattgctatttttcccttcagttctgtcagtgtttgctttatgtatttaggtactctaatgttgggtgtatatatgtttatacttgtgatatcttcctaatgaattgactcttttatcatatgaccttctttgtctcttgggatggttttttatttaaagtctatatcgtctgatagtgtggccacacctgtgctcttttggttgctatctgcatggaatatattttcctattccttcacttttagcctgtgtgtccttaaatctaaagtgagtctcttctagatagtatatagttagatcttatttttaaaattaattcagccactatatgttttttgattagggagtttactccatttacattaaagtaattattgatagggaaagacttactagttccattttgttaattggtttctttcttgtagttgttttgtcccttttgtcctctcttgctgtcttcctttgtgatttgttgattttgctttgatccttccttttttttttttctttcgtgtatcttctataggtattttctttgtggttaccaaagtcttaacagaaaacaacttatagctacagcgaaagcaatttaaaaaaatagacaaacaggactgcatctaattaaaaagcttttgcacagcaaagaaaacagttaagagactgaactggtaatctatggaataggagaaaatatttgcaaaccatgtatctaatgaggggttaatatccaaagtatataaggaacacctgcaactcaacagcca

SEQ ID NO: 93279 - DNA, 134 bp, Homo sapiens
tgtggaatagtaaggaagccagtatagttgcagcactgtgagccagtaggagagttagtggaggtgaggtctgagagctaataggagcttggaagaactgtgactggtactcggtgtgagatgagatgcccctg

SEQ ID NO: 93280 - DNA, 738 bp, Homo sapiens
gaggatgggcagggagagagaaacaggaggcagagtccctccgtaagctttcccaagtgagtaaagtactcatacccagggctttatttgaatttatcacctcttattagtgtcttttgaaatgcgaattagctgattaaccactgctcacagccttccaactgttctttattctccagcattcagcaactttgttctaaatagggtaggccacagtagcccaccagggggaaattattctcaaggttacaagaacagcgaccaaggcaaaattaggccctggcctggatggaatcaagttgggagtgaggttgtgcctggagccaggctctaaccactcccaccccccaacccggtctacacacaaagcctccgaggatgctggttaccctggtgttagtccatccttgcgatgtatgaacagggctctggggaacaagatacacactcttctgccccctaccacttttttgttgatgatcaccattttctaaaaggtttattagttctaggtccctcaggaatgcccgtgcactggcttcggctttctgtttgggacgtgggttcacgtttacgaacaacaagggatggcccctggcagagcctcgttcgcactcgctcctgcctccagtttggcaacacaacacaaaggcggtatggcttgtatacactttccaggctgagcccctattcagagggggctgcagcttgcgcgtaatgggccccctacagacaaag

SEQ ID NO: 93281 - DNA, 449 bp, Homo sapiens
tccacttagttgtgcggacgggggcgggtgggcaggcagtttctcaccttaaaggaagcggaaagaggccagagcttcaacagtggatggcctgttcccgatttctagctatcctacagccatccttttttgcttctgggtagctgtgacataatcattagggctaaaatgtgttatgttgtaaagagagcatcctacacatagatctcaatttccagggcctagcagggggtgggagaaatcagcctatgttgtattttgttgttgttcccactacaagcaagtctcctaaaaagtcgctgaaattggtgaactctttcctgtgcaacacaagaagagtgtgtgtgtgtgtgtgtgtgtgtgtgtgtgtgagagagagagagagaatttcttaaattctaacaaataaatctatagaaaatctaagttttgggtagaagtctgtaaaa

SEQ ID NO: 93282 - DNA, 1283 bp, Homo sapiens
  misc_feature (1063)..(1063): n is a, c, g, or t
  misc_feature (1065)..(1065): n is a, c, g, or t
  misc_feature (1091)..(1091): n is a, c, g, or t
  misc_feature (1106)..(1106): n is a, c, g, or t
  misc_feature (1161)..(1161): n is a, c, g, or t
ctgagaccacccaccctctccaggagcagccccagaggctctctgtctgcctgccggtaggtgttcccacctgacacactctctgggacaggatggagccataggccctcctctggcttggctgtgagtcgggaggatgcctaccgggaagtatgtgtgacatgacctgaaatcccccgacaggtcacctgggagaggccgggagagggcaagcgccacacctgccaggtggcccagctcagcccacctgcccccaccccagagctacctgcagtgggtggtcagggtggggtgtccccacaccctcttccctacccaccccttgggcctgggtaccagctgctcccacagacccactgagcacatgcgtctccactagatggttgcccgtgatgaacggagctcactggccatgaccccacaggcccagctgcacacccaggtcatgagcacggccctgccccacccccataggggccctctgacccctccactcactcatccgccaccaaagctgtggaggcctgtggcagggtctcagtcacctccatcccctgtgcccggaaccaagcccggaacacaggaggtgctctgcaagtgctcgtggggagtggctgccttggggtctaaaggcagagaggcaggaggagcaagggacgggcccactggtgctgacggcagcaccaccattcagcactgagactgaggcttaaggagtccatccaaatgactccatagccgccgcgttcaggctggaaaaggcttttcagcggagggtgctgtaactgtccagctgtgggagaggagataccagcccaggagaagagcagctggccctactgggcctagaagtttgggagacccatcccagcaaggatgggaaatcaagacagatgttgagcatggatttcccagaggtggtgactgcgccgcacagaggagcatctctgcctgggaggagggagagggctcccgccgggctgccagagccgagcaagtacctgcaccttcagccagacacatgctgggcattcttcagatgccatcgtaaggcggaggcctngnggacgtcccagaacacctatggatgnctgcccctcgggctnttctcggccacaccagatgcagaggggctgtgggagcctggaaaagggcttggtnggtccagctgctttgttgttgttgtttttgttttgtttgtttgtttgtttgtttgttttggcttggggcttttcttagaagtgatgtgttgttagaaacttcaaaccagatacaaatatacc

SEQ ID NO: 93283 - DNA, 341 bp, Homo sapiens
ttacagatcagatttggccagtgagctacagtttgccaacacctggcttagactagacacaagagctgatgaggggtggctcagaggacccgaggcatcctcacagctctaaccatcctgccccagagtatgctgcagaaggctcccaggtgggggtgagtggacaggccaggcccagcctccgaggctagccacggcaatgtccttttagggattaagtggtttcccccacagagaagctcatgtaagagcaggccagcgcatggccaggcctcagagggacgatggggtggagatggccatgctagccagaccatcaaccatggccaacaaacatctgt

SEQ ID NO: 93284 - DNA, 409 bp, Homo sapiens
gctgaagtcatgccactgcactccagcctgggcaacagagtgagactccatctcaaaaaaataaaaaataaaaaacagtaaaagaaacaagagtattaaaagcttttcctggaagatacccatttaatgcaaaagagagcaataatggaggaataaaggtacaaaaaatacataagacatgtaaaaatccaaatagcaaaatggtaaattaaaatcctagcttatcagtaatttaatcaaaagtaaatggcttaaacaccctaaccagaaggcaaagattgccagaatgagggtttttattaaaaataacccaacaatactattagagacacactttagattcaaagacacaaattggttgaaaataaaaggatggacaaagatatggcatgcaaacagtaaccaaaaa

SEQ ID NO: 93285 - DNA, 879 bp, Homo sapiens
tccagcctgggtgacaagagagaaactccctctcaaaaaataaaaataaaaagttagctgagtgtggtggcaccagcctgttgtcatagctactcaggagtccaaggctgaagaattgcttgaggtcagcctgggaaacatagcaataccccatgtctacaaaaaatgtgaaaaattagctgggcatagtggtacctgcctgtagccctagcttttctggacactgagtcaggaggatcccttgagcccaggagttcgaggctgcagttagctatactggcaccaccgcactccagcctggtgacagagtgagaccccgtctattgaaaaacatatatctgctgataaatatgtccacaatttagaccagacttagacactgaagttattaccagctccttcacacccacatgccttaactctctcttgccttcatgcattccttcactccattcattcgcttaactttcatccagcagatatctgccaagcaccagctctgtgacagacactgaggctgggggtgccagggagacctttaccaaccggacagacactgccccgcactcctggctctgtggctttctgatagtccgtggcctcacatgttcatttattaagtgtccttttattgattgagtcttcattcattctttctcttaatgtccttattcattcattcatccatcacttgctcatctcactgacacgtctattcagtcttcatatatgttttcattcctttattctccaagcatcctggaagtacccactctacaccatgccagggttagatgctgggattctggcccagcccaccacactgccaagcccatggggacacagatggtgaggacatagtggtaactacttcaccag

SEQ ID NO: 93286 - DNA, 316 bp, Homo sapiens
gattacaggcacacaccaccatgcccagctagtttttgtatttttagtagagacggggtttcgctatgttggccagactggtctcgaattcctgacctcaggtgatccgcctgccttagcctcccaaagtgctgggattacaggcatgagccaccacgcctggcctgttactgttacttttaactgggtgtggattttgaaatactgaggcacctgcaggcagcccaggtaaaactaaattagtaggcattttagagctcagtagagagagaggacatcaagatacgtattaggagttctcagcatataggaatag

SEQ ID NO: 93287 - DNA, 385 bp, Homo sapiens
taaatacaagcaccacttgtcatagtaaaataaagtagcctgccccttatttataataaaattgatttttaaaaatcctattttctgtgtgagattttatgacacagcacatagtctttccagtaagtgcagcagaactgctgcctttctgccaagtgggatagagtaccatgaaaatacacatgtttgagggtcacttagggtataatgctgaatattatagaaccactttagcatgcattactttctacctactgtaattataacattatatgtacctttcattactattaggagcttcatgctgattttttttttgtttgtttgttttgttttgtttttttgtcacagtatgactttccaattaacaaaaagagagatggct

SEQ ID NO: 93288 - DNA, 533 bp, Homo sapiens
ctgcactccagcctggccacagcgggagaccctgtctcaaaaaacaagaacatgattatcaataccagaacctcatactgaggagtaatatttctcttttctggcacataaatttctttccaggccccttagccagctaattaccagaagttcaatactctctgttaattctatccacctgccatttttaggcccctggtagtggtagaatgtagagtgacttaggacagagttctttccttctttgccaagggctgtggagattaatgtccttcactttacacttacccctctctttcctggcagttcttctagccaaaatgtaaaagcacacacagtagatatatgggaacaatgcacttctgctaaaatttgctgtgtacctaaaacttctctaaaaaattaaaagttttacatatataaagatgggatttataaatataaatttatatataaagacggggtttataaagatggggtttcaccatgtttgcacaggctggtcttgaactcctgggctcaagtgatccacc

SEQ ID NO: 93289 - DNA, 523 bp, Homo sapiens
aaattaacctttacacatctcaaaccaaacaaaaatcaacctgaaatggatcacagacctaaatgtgagagctaaaactgtaaaatttctaagataaaatatagcagaatatctttatgacttaggttgaggagagttctgagatacaactttaaaagcatgattcataaaagaaataaattgtacttcatcaaaatttaaaattttgcactttgaaacacttttttttgggagggaaaaagacaagcagcagactgggagaaaataattgcaaatcatatatctgacgaagacactggatccggaatatataaagaactacttcaacttaataagaagatgacaattcaaattttaaaatgagaaaaatatttaaatcagcattttatccaaaaagataggtgaatggctaacaagcacatgaaaaatgtttaacattattagtaataagaaaattaaaaccacaatggcataacaacactcaccagaatggctataataaaaaaaaaagatctgttggtaa

SEQ ID NO: 93290 - DNA, 567 bp, Homo sapiens
tccttattagtccatgtccagaatcagtaaatgtccctagaaaataaaatggccacttacctcaggaggactcctccctctctggaattcccattcacctagtccttattgctttcatagctctcacatatctttaaatatgatctttataatttttccatctttttctagttgttgcaggcaaagttttaggctgccatgacctactatatcctatttagaagtggaagtctctagagagattttcaaaattacagatgtgtggatattagcttttctcctaatttaattgaattgtggtgagagaaggtgttctgtattattcaaatagcttaaaatttgctgaaatgggtttataatcaaatatatggtcaaatttaatagttcatgtactcttataaatatgtattctcccattgttggatgcaatgccctttgtatgttcatgggatcaagtttgttgactgttttgtgtaaatctatatgcaaaatcttgatttttgtctacttgatctgcttctgaaagaggaacaataaaacttcccactgctacggtaaaaaagccaa

SEQ ID NO: 93291 - DNA, 522 bp, Homo sapiens
aaattaacctttacacatctcaaaccaaacaaaaatcaacctgaaatggatcacagacctaaatgtgagagctaaaactgtaaaatttctaagataaaatatagcagaatatctttatgacttaggttgaggagagttctgagatacaactttaaaagcatgattcataaaagaaataaattgtacttcatcaaaatttaaaattttgcactttgaaacacttttttttgggagggaaaaagacaagcagcagagtgagagaaggtgttctgtattattcaaatagcttaaaatttgctgaaatgggtttataatcaaatatatggtcaaatttaatagttcatgtactcttataaatatgtattctcccattgttggatgcaatgccctttgtatgttcatgggatcaagtttgttgactgttttgtgtaaatctatatgcaaaatcttgatttttgtctacttgatctgcttctgaaagaggaacaataaaacttcccactgctacggtaaaaaagccaa

SEQ ID NO: 93292 - DNA, 371 bp, Homo sapiens
aaatcatacaagtcagaaactctgatgtacattaaaaaagcaagagcatcagagaataagttaaggtaaaataaacacgtttatttttcttattcttaatggatctgatagataacagtttgttcaaataataataggcacacacacatttaatggattgaatgccaatctacctcttatattcttctccttccctttcccccaagtgtatatcccggccttaagtctgctcagtaatttccagcagcaaaatgttcttttctcctttgtgttgctaatttaaagcagtagttgaaaatgactgtatatgacgggaagaatttaatttgcagtcactccactcttcccctcactttctttttggatgatag

SEQ ID NO: 93293 - DNA, 231 bp, Homo sapiens
gtcctccctgattctcaacctttgcaacctgccttccgtcactgctaggtccacgtaggcttaaccttgatcttatatgtaggaccggtcttcaccttaagcaagagaaatgtaagaagtgctttcccaactcagttgctggcccagctttggcctcgtgttccctttctgaggactgacctttggtattgctctggagtctcatatcccctttggccctaactgaccacg

SEQ ID NO: 93294 - DNA, 346 bp, Homo sapiens
ctgagctcaagtgatcctcccacctcagcatcctgagcagctggaaccacaggcgcacaccaccatacccggctaaattttttgttttttttgtagagatggggtctccctatgttgtccaggctggtgtcaaactgcggctcaagtgatcctcccacctcagcctcccaaagtgctggattacaggagtgagccaccacacccagcctaccacttctaactgtacccagttttagtgtagtggttacttcattatctgtaaaaatgtgtgtatcttgctctttttgtttatcagtattaaaccttatctctcaacttcctgttttgatggaaaagaatcaactcc

SEQ ID NO: 93295 - DNA, 352 bp, Homo sapiens
ggttcagatgctctagaatatctgtttacttcctcttgaaggaaggcagatggggaagaaggaaaatatcatcagatagtatttggaacaagacttccagccaaccagtggcaacttcttggaggcagtctggtgaagtggctggaactctggcattagaatctgagttttgactgtatgtttctgggcaacccttggtttcctaagctccagtgacctctcaagggtgttgtgaggacagacatgagctggtgcctgtgttctgtaccaggttgccataaagaatggtgttctttgcgtcttgtcattttgaactcctcttccaaaggagcctgggaaaccctctgcttac

SEQ ID NO: 93296 - DNA, 145 bp, Homo sapiens
gaaaagaaaaaaaaggaaagaaagaaaggaaggaaggagagagaaagaaagaaaagaaagaacgaaagaaagaaagaaagaaagaaagaaggaaagaaagaaagaaaaaaaaagaaagaaagaaagattacataaaatttggaaa

SEQ ID NO: 93297 - DNA, 493 bp, Homo sapiens
cttgaaacttagaagaaaattttgaaattgataattgtggagaacttcaggatgtgaaatatttgaatcttctgtctagggcgttcaatatttattgatgaaagtcttgtatgaggtaagtaaccatgacccaagttataacttacagcagcttttgtgagttatgcgaggtgatagggccacttgagagagcccctacagagttatagggccagatagcagatgttttattctttgcaggtgaaagcagccatagtaagtgaatagctctggcttgttaactttgctggatttggcctgcagactgcagtttgtcaggccctgcactacagattgtggaatcatcatttcatttatctcagttgcagcatcgaggtaatcagggtcctgatttcataattgaaacaggtggaatgattaacctgcttaagatcatacagcttaggatgtgcttgagttaagacccaagtcagagtggtgctattataccttc

SEQ ID NO: 93298 - DNA, 573 bp, Homo sapiens
ccgtgattagaggatcccgcacgaggggtgcccaggaaacttactctcccacctgctgccccatccctcccctcttcctcaccataggcagagagagtcatagggcatgttgggaagcagctacgcgctcctatctgtgcattaaggaagcacaagtgagggcctggacatagagacggtccctgacctacgatggttccacttaagatttttcaactttatgatggtgcaaaagtgataggcttcctgtagaaactgtacttcaagtacctatacagccattccggttttcgttttttgttttttgtttttttttgtttttttgagatggagtcttgctcttgtcacccaggctggagggcaatggtgcaatctcggctcactacaacctcctcctcccgggttcaagtgattctcctgcctcatcctcccaagtagctgggattacaggtgcctgccaccacacccggctaatttttgtatttttagtaaagacagggtttcactacgttggccaggctggtctcgaactcttgacctcaggtgatccacctgcctcggcctcccaaagtg

SEQ ID NO: 93299 - DNA, 229 bp, Homo sapiens
acactatttaataagataatggactaacatttctagtaatctgttttgccagtggctttaaattgcaaataagtcagagaatattattcctgtaggttgaattattactcattttttcttatttaaacttatttttcttaatttttgtgggtacatagtatgtgtaaatatggcatatatggcatattttgatacaggtatataatatgtaataattacatatgggtaa

SEQ ID NO: 93300 - DNA, 136 bp, Homo sapiens
atggtttcttctgtatggctgagactgtctccagtctttagggacaggcaatctgaagtgatttgatttttttctttttttgttgtttgtttgttgtttctttgtttgtttggagatgaggtcttgctctttgccc

SEQ ID NO: 93301 - DNA, 747 bp, Homo sapiens
gttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattgg

SEQ ID NO: 93302 - DNA, 361 bp, Homo sapiens
gagctaggcaaagagtgtgtgtgtttagctacaaactaagtcacagatcaagaggcttttggtattcttccatttttgcttagaattctatgatggtttttgaaatatattgtccttactttatgttcttacctgtaatctcataagtttctggtaaatttagcttttgccaggttccggtgggtcttacccagagatggtcagagtaaatgaacaaaagaaggaattgattaggatgtgaaacttcagatacgctcacaggccttcaagccctagaaagtagtatgccagtgaattttctagtcctctctacactttgtacagatgaagaaaccgagacccagggaactcaaccaaggtt

SEQ ID NO: 93303 - DNA, 344 bp, Homo sapiens
aagaagcatagtccctagactgagggagaacctgttctatttgacagaggatacctggcctctagctgggtgaggctcctggctgatgaggaagacagagtcactgacttgagggaggccctggcttgtctgatgggggagacactgtgctgtgctaagggaagccctgtctcatggcaaaggtctgcctcagagctggagatgggccctggaattcccctgcaggtagacctatctcagtgaaaggcatagcctctgccctccaggaattttccatctattccggtgccatgctgtggatgctgaggagagatgggggatggctacaaagcacactgcagtga

SEQ ID NO: 93304 - DNA, 516 bp, Homo sapiens
ttagctagttgtgatgtattttggcttttaagatattgttcccacacatgaaactcacaaacgttgctaagttaaagcacctaacttttcattgactctagcattcaaaaatctcacaaaccctggtctgtccatatcttaaactctatacaccagtttttttgccactgcatttattccacggcctgcatacagtgtgatctggcatatatgcaagaacacttaagtaaagttctgcatgcttgattgagaaaaagacttttattctaaaaacaaagaagctatattaataatctttttggaaagagaatattttacaacattcccttgtctacactgcttggaataagcactttgaaataagacaagcactttggaataagacaagacggtatacagaataataaatcactggcattaggcaaaggggttgacttatttgtgtatcatggatcttagatttactgatcctcagatttttaaattcctgctgattctctttctcaaaaccaatat

SEQ ID NO: 93305 - DNA, 332 bp, Homo sapiens
gagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagtt

SEQ ID NO: 93306 - DNA, 1306 bp, Homo sapiens
tgatattgaaccatttctgctccttttcagacactacccctctctctcaactataatcactttcctaacttctatcaccattgactacttttccttttatctttatatatatgaaaccatattgtatatatccttttgtgtctctgttttgcccaacattatgtttgtgagattgaactatgctgctgttttatagcaattgtttacttattttgttactgtagagcaagtgtaggcacactacatcccatgggtgaaatcttgtatatatttcggggtgcacatgtgtgtgtgtttctgcttgctagaagtggaatttctgtgtcatggagaatacataaatttaactctagcagatactgtgaaacattttccaaagtgattgtaccaatttacactcttacaaggaccgtggtagagttccatctgctccacgtgcttgccaatgtttggtgttgtcagacttaaattatttttaaattattttttaaattcaccattctaattttttaaaagaagtagagtataatgctggttaccaggggctggagtggaggggttgggacatattggtcaaaagatataacatgtcagttatacacgagtaatttttaaaaaatcagtgattctggtatggcaatagagttgtctcattgagggtttaatttatactgctgtaatgactaatgaagttgagcaaacagagcatgtatctgaagccttgtacatttgtatattcttcatatagtgcttactcaagtgatttgttgatttgtctatttggttgtcagtcttattcttgtatttataggatttctttatattctgcttacaagccttttgacatatgtgtgtattgtgattatcttttcaactgtggccagcattttcactttccttatggtacatttgataaacaaccattctcattttaagttttttaattttacttttcagttggtactttaaaaaatcgttgccaacattagagaaggtcacaaagatattttagtagctatttaaaaaaatcttttaattttaagatctatattccatatcatattgatatttacatatgggatgtgctaaaggtcaagattaattatttttctatgtgaagaatatacaatatcctcacttcttaagagatttctccattttattatctttgtcaaatatcaaatgactagatatatgtaaatctgtttctgaactttctattatcttccattagtctattcatatttgcatatatagcacacttttaattactgcaaatacataaaatgtcttgatgtcttatcgc

SEQ ID NO: 93307 - DNA, 926 bp, Homo sapiens
tgatattgaaccatttctgctccttttcagacactacccctctctctcaactataatcactttcctaacttctatcaccattgactacttttccttttatctttatatatatgaaaccatattgtatatatccttttgtgtctctgttttgcccaacattatgtttgtgagattgaactatgctgctgttttatagcaattgtttacttattttgttactgtagagcaagtgtaggcacactacatcccatgggtgaaatcttgtatatatttcggggtgcacatgtgtgtgtgtttctgcttgctagaagtggaatttctgtgtcatggagaatacataaatttaactctagcagatactgtgaaacattttccaaagtgattgtaccaatttacactcttacaaggaccgtggtagagttccatctgctccacgtgcttgccaatgtttggtgttgtcagacttaaattatttttaaattattttttaaattcaccattctaattttttaaaagaagtagagtataatgctggttaccaggggctggagtggaggggttgggacatattggtcaaaagatataacatgtcagttatacacgagtaatttttaaaaaatcagtgattctggtatggcaatagagttgtctcattgagggtttaatttatactgctgtaatgactaatgaagttgagcaaacagagcatgtatctgaagccttgtacatttgtatattcttcatatatggcgtacccagggaatggggaatggccaaatggggggcagcctaaccggaattaaaggacactgaaatccgggcagccctggaaccagtgtttgggaaacttcaaggggcgcataatactccatgggccatggccactcattggttgcaccccccagggcaccgcgcgggccctcgcc

SEQ ID NO: 93308 - DNA, 1452 bp, Homo sapiens
  misc_feature (1416)..(1416): n is a, c, g, or t
  misc_feature (1421)..(1421): n is a, c, g, or t
tcagggtgctgtatgaagctgggtgtgggcggattcctcccacaccttcacactggcctgcctccaactcatacagatctcggagcggtcggtacttcattcataggtccctgttcaggcagcagttctgtgggctgtggccctctcccctccaatatgtccgaaaccattgtgatgggtggcaaatcccagggagctcctaagccctgctctgcccacatcactgccagcagagaagtcagaggaagggacttgttgctaaaaaatcctttaaaaggttaaatactttaaaagattaaagcaacataactgtaaacatatcgtataaaaatgaaaaacacaggaaccctcttcccttccgcctggtgtgggcttgggaaatgggcaagcggccccagcaatcatgggaggaactcttgcgggggagcggtctgggattccaaatgggcaggtcacacgaaggtcacgatgcttctctgcatcctgaaaagggctggggacagggccagtgggggtggtaagggtatttatagcacagtgcttgaaaagggaagattaatgtgtaaatataaaggacacacaggctgggggttggtcagaggcaagaggagggtgcctctgagcttcaacccctcccaggaacaatgagctcaaattggaagagtccagtggaatcggggggatggtgtgagcgcccctgttcagtctttgacaattgcatacagaaaagcagctggtatggggttgggtgtcaatgaaagggccaaagactggtggccagctggtttgggggatttgggccattgatagcatctcccaggaacaacgactttttgcctccaaagttggatctagtgatgatcagcaccagcaggaaatgacatttggtgtctgcccactgcagccatactgtgacctccagccagacttccgcctaattgactccactggatttgtgctctgttgagtcagaggctcccgggggttggggatcgaggggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttctaatgtttgttatacttgtacagagtattgctgttggttgcttttttttttttttaaggaaaaaatggcctgaaaacatttttttaaagacttacaaataccaaatataaaaaaatggtcatggccgccncgtgncgaaaaaaatagatctttaacaaaaaatcct

SEQ ID NO: 93309 - DNA, 623 bp, Homo sapiens
  misc_feature (38)..(38): n is a, c, g, or t
tctaggtctgtaatttattaactggctactgggaaatnacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtaacatgttaccattctgatgtaggaggtcatctgttttcctcttttcctctcctctgactcttaagccctttcccattctctttctcaggaatggctgttaaaatgccaatatggtcttgtaactttcctgtacttagtgaacctccttatttacaccctgtttgtgaagtggctgtgttcaccctgggtggacacggaatgtttttggcatgtacaaagagaattttatgctgcctgtgtacagttattaatttgtaagtacactcagctttttgtatctgtaggtttaatatctgtgtatgtaagcaaacttggatgcaaaatatttgaaataaaatcagatgcttgcatctgtagtgaacataaaaaaacttt

SEQ ID NO: 93310 - DNA, 1025 bp, Homo sapiens
ggtcttcagccttaaggctatgtttccagtgttctctggctgtttccaagagctacaagaaaagaataaatctctggagttggtgtcctttgaggaggtagctgtgcacttcacctgggaggagtggcaggacctggatgacgctcagaggaccctgtacagggacgtgatgctggagacctacagcagcctggtatcattggggcattgcattaccaaacctgagatgatcttcaagctagagcaaggagcagagccatggatagtagaagaaaccctaagcctgagactttcaggtggaagcaagaagcaagttttctcaggtatttgccacaggagcctggtggagctccaggaggtttgatctctcttgtgaactctggaactgtattcccaattgtcaattggacatccctacgtatgggacctcagatatttcaaacatgatgtgtccaagtctgtatcacttctggccatcatattgttcttttatttttccaaatttcacatcaccagtaacaaactagctgtgatcatggcagatagcctggaaataaaactcccctttttaccctttgcacagcaaattgacatcaaatcctgtttctacttttttttttttaactattgcttccctattctgtattctcactgctccatcttctgatgtaggaggtcatctgttttcctcttttcctctcctctgactcttaagccctttcccattctctttctcaggaatggctgttaaaatgccaatatggtcttgtaactttcctgtacttagtgaacctccttatttacaccctgtttgtgaagtggctgtgttcaccctgggtggacacggaatgtttttggcatgtacaaagagaattttatgctgcctgtgtacagttattaatttgtaagtacactcagctttttgtatctgtaggtttaatatctgtgtatgtaagcaaacttggatgcaaaatatttgaaataaaatcagatgcttgcatctgtagtgaacataaaaaaacttt

SEQ ID NO: 93311 - DNA, 607 bp, Homo sapiens
ggtcttcagccttaaggctatgtttccagtgttctctggctgtttccaagagctacaagaaaagaataaatctctggagttggtgtcctttgaggaggtagctgtgcacttcacctgggaggagtggcaggacctggatgacgctcagaggaccctgtacagggacgtgatgctggagacctacagcagcctggtatcattggggcattgcattaccaaacctgagatgatcttcaagctagagcaaggagcagagccatggatagtagaagaaaccctaagcctgagactttcagggtgacactctatcatccaggctggtgcaatcacaactcactgcagcctcaacttcctgagctcaagcaatcctcccacctcagcttcccaagtacctgagaccacaggcatgtgacaccacacctggtgtattttagtattttcttgtacacagagggttttgccatgtttcccaggttggtctcaaactcctgggctcaaaggatcctcctgcctcagcttcccaatgtgttgtgattacaggcatgaaccaccgtgcctggccttaatattcttttctatttgtaaatggaaagcttcagaaaagacc

SEQ ID NO: 93312 - DNA, 918 bp, Homo sapiens
ggtcttcagccttaaggctatgtttccagtgttctctggctgtttccaagagctacaagaaaagaataaatctctggagttggtgtcctttgaggaggtagctgtgcacttcacctgggaggagtggcaggacctggatgacgctcagaggaccctgtacagggacgtgatgctggagacctacagcagcctggtatcattggggcattgcattaccaaacctgagatgatcttcaagctagagcaaggaggtttgatctctcttgtgaactctggaactgtattcccaattgtcaattggacatccctacgtatgggacctcagatatttcaaacatgatgtgtccaagtctgtatcacttctggccatcatattgttcttttatttttccaaatttcacatcaccagtaacaaactagctgtgatcatggcagatagcctggaaataaaactcccctttttaccctttgcacagcaaattgacatcaaatcctgtttctacttttttttttttaactattgcttccctattctgtattctcactgctccatcttctgatgtaggaggtcatctgttttcctcttttcctctcctctgactcttaagccctttcccattctctttctcaggaatggctgttaaaatgccaatatggtcttgtaactttcctgtacttagtgaacctccttatttacaccctgtttgtgaagtggctgtgttcaccctgggtggacacggaatgtttttggcatgtacaaagagaattttatgctgcctgtgtacagttattaatttgtaagtacactcagctttttgtatctgtaggtttaatatctgtgtatgtaagcaaacttggatgcaaaatatttgaaataaaatcagatgcttgcatctgtagtgaacataaaaaaacttt

SEQ ID NO: 93313 - DNA, 349 bp, Homo sapiens
taagacacaggatctgtcttaggcttcctttagtggtgaaacagtgtggcctaatgggaggaggcttattggtagactaacagagaagcagacaactcttttccagtgtcctgcttatttgcaaggaaggcagacatctcggggaaaagaatttcttgttctaggatctatctcttggttgtgatttaaaataaaaaagaaggttcctttggtctcagcccctgtaactgttgtaattggtgagacataagcttggtagtcttttgggttttttcttgctccagagtcctctcaaaatgttcagctaaggccaccaattcagtcatgtctgtaacttcccatccaggtt

SEQ ID NO: 93314 - DNA, 290 bp, Homo sapiens
gtgattctcctagagatgcatgagtccttaatgaaagctgccctcactattcttgaaaaagccacttgcatttatagataacagagggtaaactttaaacacaactgcataaagtggcaaggaactggcctgccgtcagctcactgaatttggattccatgcaagcaggatgtgtaaaggaggtaaactccaaaagtgtttttcctcccttaataaggtctattcttcttggtgtcaaggtatgaaaagcagtatttcatatcaacgttcatggttaatctttttgatag

SEQ ID NO: 93315 - DNA, 308 bp, Homo sapiens
tccgtccacagcaggtgggtgtcctgtttccagccagttctgctggcccgtcctcctcttccctgaaggctgaagtgtgatcttcagaggagtgtgttctgtggtcagccggcagcagcggcccctctgaaggcccaccaggaaaggatgggagatcctccaggagttcatgctgctgcatcagtggtcccctcccggcaccacccagaggtccccagaacacactcctctgaagatcacacttcagccttcagggaagaggaggactgggccagcagaactggctggaaacagtgaacacccacctg

SEQ ID NO: 93316 - DNA, 134 bp, Homo sapiens
gcaaagttcagcggcccgcaagaccacctccagatttaacagttcactagaaggacccacagaactctctgaaagctgttatattcatgtatgttttattatagcataaggacacacattaacgctaaccgagg

SEQ ID NO: 93317 - DNA, 475 bp, Homo sapiens
cagtgagctgagatcctgccactgcactccaacctgggggtaacagagcgagactctgtctcaaaaaaaaaaaaaagtgtaattagaaatggaaatctaggtaaaggaagctttaaaatgttgtattttttccctgaaataaacttttatgatttaatgtcttggaaaaagactcacatgaaaagtggcttttatatttggtaggataaagccattgtcctttaataccatagcaaatagaagcaatttttaatgaggttactgaattgtttagtattcctaatatggcatccaggtcatcttttcttttctccaaccattattaaaataacttgacactttgggaggccaagctgggcagatcacctgaggtcaggagtttgagaccagcctggccaacatggtgaaaccccatctctactaaaaaaaatacaaaaattagcggggccatggtgacgtgcacctgtaatcccag

SEQ ID NO: 93318 - DNA, 430 bp, Homo sapiens
tcctcactgtggagagggcagctgctgacctgcagcaagccaggtggcggatcaagatttgtgccaagtgaggggccaaacttagcgtgggcatgcgtgcttttctctttacatgtgtccaaggccataagcgatgggctgtgacaaagcacatctgggctgagctcagggagaaatgtcccctgcagtagatatgcaagtgtgtgcaggtgtcagaaacaccaagccacacactgataactcatgccgggtgcggcggctcacacctgtaactcagcactttgggaggcagaggcgggaggatcgcttgagctcaggagtttgagaccagcctgggcaacatggctaaactgccccccaacaaaaaataaaaaatccggggatggtggcatgtgtctgaagtcacagctactcgggaggctgaggtggg

SEQ ID NO: 93319 - DNA, 395 bp, Homo sapiens
agctgtacagttggaaatgttttttagaatttttttttgtaaaatgtttttaacttccttcttattatgatttcttttttattgtattcttgtttattttcatctttctctttttaatcctctctttgaatttgagatgataaccagaattatgttaatcagtatctttgaactttgccaaaagtcgatggcaaagtattttcaaaatcatttgaatatttgtaatattttcatattttttaaaatcagcaatcctgttcggtatatgtgatgagtttttgaacattcaataagttggctttcacaagataaaaatctcttgctgaacagctgctggaacccaatgtgaatattggactggcggagccttgggaagtgaaccttccataggaagc

SEQ ID NO: 93320 - DNA, 1848 bp, Homo sapiens
attttttcccaggattcaaaatatacccgctagaatggaaaacaaaaatttgaatgattacaacattatcgttaacattcaattttgtatttattgttttattgaatatagttcagagtatattaaaatagacctaccacttcaaatgataatgattattataatgtctcttcaccctattctagcacttctgcttgcagtatgtggtttctatttttttcctcttgtataattccacttgcttttaattgttgtttcattatataaaaggaacatcttcccatagcatattctatgaaaggggtttcattccaagttgagttttcaaaaaaaaggtcttcctaaagctaccattttcaaccgtcctgttatctagtacaacataaataacagtcttaaaaattgcactaataccagtgcccccctggctctccaaatctgttctttgctcttgtatctgctggacgcttgaagacaggtgcactgtctcgtatgtatttgaattatgaacagtaatttctaatgaattctaaaatggtcattgtaagtgaaagcctctcgctaccacttcctcttccaactacataaatatatttcaatgtatttccagttttggaaagttttcaatacatacatcaagtgtttacttagatttttataaaaattttttttacaatctaataatctttggtaaaggaactagagatgcatgcagttgcaaaattaatgtatttattttccagcataattttattaacttcactttttttctctctagtaaatatccagtgtacttatgaactcatgtttggctcttttaaaaccttttctaaaagctagatcagcatttttctattttacaagttttttgtataaaaaggtgaacatatgagatattgtgagaaatcattttaagtttcatttaaatcatggtgcctcttttgatactttcttaaaattgtgcaagaagaaatcatttttagtagtggtcataaatattatccttttggcagtaagctattactaattcagcctgaagctcggtagacaatatgtctacatgtgtttgagtacatcctggatacagtttcccagctcatgagggactgaaaatagtcttattcatcaacccactaggatgtgaagggttaagtctagatttggtcgcattgaaaccccacaatatagaattaataaatggccttcagtaggaaaacctacactaaagcaaatccgaagaagtggggcagggggaaagaggcattactggtctttccttttgttttgcaagcataatttgattttcctttggctcagaaaactcatttggggaaattctcttttgtgttcagtttaacctagaaaggtcctcttgaaaaaccaacattttaggaaagttcttttttcaggatggagtatattaaaattaagccaggctttgacgtgaattatcacttttctttattattttgttttctattttggtttatagctatttctggttcagttctgaacttcagcacttaatcatccttatcaaccaggcttttggtagcctaaaccgctatgctgttgtttttttaatttaaagatgtataagccaaaatttggatgggagtgagacataactgatttatatgaattttaacagagttgtatttgtgtgtgtttaataaaatatatatttattcagtactttcctcagtattttatgggcaaagtaaaaataacaatgcatagtgaaagggcatatattaccagcagtaataattcaaaatcctgaaaatgtttcattttttttgtttttgttatgcagaataaacaaggcagaaatgctctttgaaccac

SEQ ID NO: 93321 - DNA, 695 bp, Homo sapiens
tctttcctaacatagtctattctctaagaatagagaagatatgtatcagtcactcttatagtctgaaaacctaaacataaaagtaatctgcttttgacatataattttgtataatacgtatgaaaaaatgtgacagctaaggacttgaattaaatccctaaaaaacaccaattagccactcattaagccaagactttaattctatgatcaattagcactgtttatctgaattaagcttttttgtggtctaacaaaaagtttttttgtggtctatcaaggagacagctgttcaaatggaaggatacatgtggggcaggggggcggtgaagagacctagattctggtcctaactgctttgccttggagagattaattcccccctctaagcctcagtttcctctgaagatgttggaccagataacctctaaggtcctttgaaactgactccttgattccatgactcactgaatatttttctgcaaagataatcccaaccaatgccttctatcctaatctaacaaaaaattgctcttcatcatagaaatacaaagtaatcttcagtgatgtgctctttatactttgctttttaaaccgtccattccagttggtcttaatatattgcacaagtattttataagtgaaatgtgtacagaatcatattctaagattatgtgcaaatatatgtgtagaaagag

SEQ ID NO: 93322 - DNA, 418 bp, Homo sapiens
aaaacagcaataaattggaaagaactcaaatgtccaacataatcttataatctggtacaatcatatcatggaaactgtacacattaaaagctgcagagcccttttcacaagatggcaccgaaagcaaagaaggaagctcctgcccctcctcaagccgaagccaaagcaaaggctgtgaaggccaagaaagcagtgttgaaaggcgtccacagccggaaaaaaaaaagatccacacatcacccaccttccagcggcccaaaacactgcgactccaggggcagcccaaatatcctcagaagagcgccgccaggagaaacaagcttgaccaccatattatcatcaagttgccgctgaccactgagtctgccatgaagaagagcgaggacaacaagacacttgtgttcattgtagatgttaa

SEQ ID NO: 93323 - DNA, 353 bp, Homo sapiens
gaagatactttatgatatgatcatttcctgagttgtattaatcatctttttctccttatgggatctgattataggaaagttagtatcacaaaatcaacatacaaagatgagtagcatttctatataccagtattcttcaagctgagaaccaaatcaagaactcaaacccatttaaaatagccacacaataataaaatatgtagaaatacatttaaccaaggaggattgcaaacgtgcatgtgcaaaagctttgaaaaagaaaaagaggatgccaagcttcggtttccagtagattccggaaatttcggagaagcattttaacattcttatatgtcacttgttttcttatggct

SEQ ID NO: 93324 - DNA, 267 bp, Homo sapiens
attgttctaggtgaaatgtaaggagcctattttgtgggaaaacaggtttttttcacgttaaaagtcactgtcaggaatttaataaaggtcgtcggacttgaccacagaagttcttttgaggtcgtgtgaatagtacattgacattgtattccaagtaaattttgccctgtctaatctcctgccttctagtctaagtcatgaacatgacaccttttcacgaatgtacattctttatttacctgttggtagtttctactacaaaatctg

SEQ ID NO: 93325 - DNA, 195 bp, Homo sapiens
aagggttttgatgggccttttaactctagagaccagctagtccctaacatcaggtttgctagagaagggaagattctttccagccttcctggatgacacctaatacatactatattcctagtaattctgttatacttaagatttatgggttcatctttcctgttacactgtgagcccttcctgggctgggacgat

SEQ ID NO: 93326 - DNA, 373 bp, Homo sapiens
tctcaatttggatacgttaaattactttttaagagaaagaagtaattcaccatttttagtgtttttgaccattatttgtctccaaatgccagaaacctctgttaaactataaatcttgatagtcctctgtctttagaatggagacttttttgaggtttttagcaatgcccaacaatgtacaactttgtttccagtgtgaaccaaatcacctttctcaccttgccccaagcaagagtaaaccgcatagatttcttcagagagaagataggaaaagtggcatccaagggagcgtcctggttgcttaagggttaagggagcggttcgaaccggcccgagcgttgggggattcggaggagggcgcgggaggcaggag

SEQ ID NO: 93327 - DNA, 3869 bp, Homo sapiens
gcttcctccagagggcgggaaccttggacgtggcggggctgggtcagtcagggcgctgggcccagcctctctgcaggctggccttccgcgctgccgtgaagcccccgacaggtcccacgcctgcctaggtagaccggcgccagcccgagtgacgcctggcgtgtggccgcgggcaggcggctccgtgcggcggggcgggcgggtgccacacctgtgcgggcaagggcggggcgggaaggtgcgcaggcgcgctcggggctggtgggcggtggctcctgggaagttgcgcagccgaactggccggctgggcgcgcgctcttgcggtggcgtaatctctcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaagatccagctatgggacacagcaggacaagaacgattcagaaagagcatggttcagcactactacagaaatgtacatgctgttgtcttcgtgtatgatatgaccaacatggctagttttcatagcctaccatcttggatagaagaatgcaaacaacatttgctagccaatgatataccacggattcttgttggaaataaatgtgacttgagaagtgccatacaggtacccacagacttggcacaaaaatttgctgacacacacagtatgcctttgtttgaaacgtctgctaaaaaccccaatgataatgaccatgtggaagctatatttatgaccttggctcataagcttaagagccacaaaccattaatgcttagtcagccccctgataatggaattatcctgaagcctgaaccaaagcctgcaatgacgtgctggtgctaaataacagtctttattatattatctaattttgactaaagaaatacttttgaagtatgacagtattaagtcataagatttaatctcaactataatgggtcatcttgacactttgctgtttgtcattgtcacgcttttgtattttgtatctacttaagtttgtcactgtgacaacacaggaaaagttggttttcaggtgagattgaaaatgaagcaaagataggatgaatctgaacatctctccatctagagcccaatgaaggaagcttcaaatgagaacatgatggaatcagtaaccattcaatcttttgtcctaggattggaaaaaaatgttaaaggtttaggacacacctaatagtatgtcctttgaatgggaagtgttcttaataggataaaaactggtatttgcctctccccagagtactttttttgttttttcatagagacggggtcttgctatgttgtccaggctggccttgagctcctgggctcaagcaatcctcccacctcagcctccccagtactgggactgtaggtactcaccactgcatctggcctttctttgttttattaacatatttagttttgttattattggtatgttttagagccaagactttagttccagtgggataagaaggcatagaatgttttctggttcccagtccataaagaatgacttttccaagagttctagatgtttgattttctaattaatacttatcagatctacaaaaatcattattattttaaaagagttatttgagtttctttctttctttttttttttttttttttttgagatggagtctcgctctgtctccaggctggagtgcagtggcgtcatctcggctcactgcaacctccgcctcccaggttcaagtgattctcctgcctcagcctcccgagtagctgggattacaggcgtgcactaccacacccagctgatttttgtatttttagtatagatggggtttcaccatgttggccaggatggtctcgatctcttgacctcatgatccacccgcctcagcttcccaaagtgctgggattacaggtgtgagtcactgcacccagccgagttgctttcttactaaatcctattaaaatatgcaaaaataagtcagattttaaggcaaataaagtgacataaggtgctttatattttattttggtatatttaaacagtgaaaaactaactgaaagcacatgaagagttgtaacttgggggaaaataggtaaacatagcttctagctaacacaggagacctattcttagcctttactaatttcaagcagtgtatcccatatggtatctcttgctcttccttcaactccaataaatttaatgactaaatgccaagttaacaaatcaacttccatttggattgtaggtgtgaaggcacaactctaattgctattagtctacatgtatttctgtaatagtattgtgtcatatcaatttttaagatgtctaaattttatggtcacaagttatccctcctcagtatgaaaaataaattagatattgaaaaatgtctaaacttcagtgatggaaagaatatttcaagaagttttttaacctaaatacttttattttgaatttaagtctttgcacataaaatatagcaagcttacatattaaactatttacgtaaatggaatgtaagccatgactttaactgaagtgttcacattcactaattttgatagattgctgtccttaataattttggaggaaattaagccaaatgattattgtactacagtattttcagaatatgggaaatcaattaaaaatgtaatctaatctagtttaagatttttgtttaatcatcatggtggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgcttttcaaaatattttctaaagtgggggaagaaagtttatagactttccaagcacatttatggttttttattactattattatggttttaaaaagagtaactttatttctttttgtaaggaattaagtaatatcctttacagttctgtgaaaggacttattttttaactgtaatatttattagttttaaaatatttgtatctcatttgtaacaatttgttttaattttttatatatatgtttttatttttaaaaaacataccagttgaatggggttaaagctttcaatatcttaaaatatttataaaacatttcactgttgcaaaatcacttccaaaatgatagctatctaacaactaattactaatttttaaagaacaaatcacacatttaaaaaatctgtagaatttattttaactatgacctttaattgaaaataaataattaaaatatcagacatgttttggaaaagtcttaatttgagaacaccaaaggaaactaccccagaatctaatgtagttcgctattaataacaatgcattattgaaagtatattgcaaatacatgtttcctcatgaaatctaagtaattttgttgtggctaagctggtttattgaacttcatgggggaaatgtaacagtgacactattccacgtcgacg

SEQ ID NO: 93328 - DNA, 389 bp, Homo sapiens
cctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaaggtgagcggatggggaactgttggggaggacagggtgacaggtgtcccaaccccaccgtgggctggtcgctggccgtgtgcacggtgtgtgtgcgctccatttttttctcacgctgatgagattggagttggggattggaaggattgcaatactgcaaacttctaaggcagcgtttctcagacttcattgtgcatgcgatttacctggggatcttgttt

SEQ ID NO: 93329 - DNA, 3876 bp, Homo sapiens
gcttcctccagagggcgggaaccttggacgtggcggggctgggtcagtcagggcgctgggcccagcctctctgcaggctggccttccgcgctgccgtgaagcccccgacaggtcccacgcctgcctaggtagaccggcgccagcccgagtgacgcctggcgtgtggccgcgggcaggcggctccgtgcggcggggcgggcgggtgccacacctgtgcgggcaagggcggggcgggaaggtgcgcaggcgcgctcggggctggtgggcggtggctcctgggaagttgcgcagccgaactggccggctgggcgcgcgctcttgcggtggcgtaatctctcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaagatccagctatgggacacagcaggacaagaacgattcagaaagagcatggttcagcactactacagaaatgtacatgctgttgtcttcgtgtatgatatgaccaacatggctagttttcatagcctaccatcttggatagaagaatgcaaacaacatttgctagccaatgatataccacggattcttgttggaaataaatgtgacttgagaagtgccatacaggtacccacagacttggcacaaaaatttgctgacacacacagtatgcctttgtttgaaacgtctgctaaaaaccccaatgataatgaccatgtggaagctatatttatgaccttggctcataagcttaagagccacaaaccattaatgcttagtcagccccctgataatggaattatcctgaagcctgaaccaaagcctgcaatgacgtgctggtgctaaataacagtctttattatattatctaattttgactaaagaaatacttttgaagtatgacagtattaagtcataagatttaatctcaactataatgggtcatcttgacactttgctgtttgtcattgtcacgcttttgtattttgtatctacttaagtttgtcactgtgacaacacaggaaaagttggttttcaggtgagattgaaaatgaagcaaagataggatgaatctgaacatctctccatctagagcccaatgaaggaagcttcaaatgagaacatgatggaatcagtaaccattcaatcttttgtcctaggattggaaaaaaatgttaaaggtttaggacacacctaatagtatgtcctttgaatgggaagtgttcttaataggataaaaactggtatttgcctctccccagagtactttttttgttttttcatagagacggggtcttgctatgttgtccaggctggccttgagctcctgggctcaagcaatcctcccacctcagcctccccagtactgggactgtaggtactcaccactgcatctggcctttctttgttttattaacatatttagttttgttattattggtatgttttagagccaagactttagttccagtgggataagaaggcatagaatgttttctggttcccagtccataaagaatgacttttccaagagttctagatgtttgattttctaattaatacttatcagatctacaaaaatcattattattttaaaagagttatttgagtttctttctttctttttttttttttttttttttgagatggagtctcgctctgtctccaggctggagtgcagtggcgtcatctcggctcactgcaacctccgcctcccaggttcaagtgattctcctgcctcagcctcccgagtagctgggattacaggcgtgcactaccacacccagctgatttttgtatttttagtatagatggggtttcaccatgttggccaggatggtctcgatctcttgacctcatgatccacccgcctcagcttcccaaagtgctgggattacaggtgtgagtcactgcacccagccgagttgctttcttactaaatcctattaaaatatgcaaaaataagtcagattttaaggcaaataaagtgacataaggtgctttatattttattttggtatatttaaacagtgaaaaactaactgaaagcacatgaagagttgtaacttgggggaaaataggtaaacatagcttctagctaacacaggagacctattcttagcctttactaatttcaagcagtgtatcccatatggtatctcttgctcttccttcaactccaataaatttaatgactaaatgccaagttaacaaatcaacttccatttggattgtaggtgtgaaggcacaactctaattgctattagtctacatgtatttctgtaatagtattgtgtcatatcaatttttaagatgtctaaattttatggtcacaagttatccctcctcagtatgaaaaataaattagatattgaaaaatgtctaaacttcagtgatggaaagaatatttcaagaagttttttaacctaaatacttttattttgaatttaagtctttgcacataaaatatagcaagcttacatattaaactatttacgtaaatggaatgtaagccatgactttaactgaagtgttcacattcactaattttgatagattgctgtccttaataattttggaggaaattaagccaaatgattattgtactacagtattttcagaatatgggaaatcaattaaaaatgtaatctaatctagtttaagatttttgtttaatcatcatggtggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgcttttcaaaatattttctaaagtgggggaagaaagtttatagactttccaagcacatttatggttttttattactattattatggttttaaaaagagtaactttatttctttttgtaaggaattaagtaatatcctttacagttctgtgaaaggacttattttttaactgtaatatttattagttttaaaatatttgtatctcatttgtaacaatttgttttaattttttatatatatgtttttatttttaaaaaacataccagttgaatggggttaaagctttcaatatcttaaaatatttataaaacatttcactgttgcaaaatcacttccaaaatgatagctatctaacaactaattactaatttttaaagaacaaatcacacatttaaaaaatctgtagaatttattttaactatgacctttaattgaaaataaataattaaaatatcagacatgttttggaaaagtcttaatttgagaacaccaaaggaaactaccccagaatctaatgtagttcgctattaataacaatgcattattgaaagtatattgcaaatacatgtttcctcatgaaatctaagtaattttgttgtggaatagtgtcactgttacatttcccccatgaagttcaataaaccagcttagccacaaagaaaaaaaaaa

SEQ ID NO: 93330 - DNA, 125 bp, Homo sapiens
taaggtaactctaatgtacattccttaactctgaagctaacagctatgaaggtgaatgccgatagctgctgtaggtttcacagagagactcaatgattatgaagattctgaccatatctaataac

SEQ ID NO: 93331 - DNA, 395 bp, Homo sapiens
taaatacttacccctaaaaatgaaatagaatgttttgagttttcttctcctgagaatatatgtaataccatactctgttaaaaattcttaaaatatttctaattatttaatatacatttctgaaaggaggatttttaaagctactgaaacaaagtgcaaatgacagccttgaaaagtaccaagttatcctcttgaccgcagtaggtagaaatcctgccttttcttctccctttttttttttaggaatcagcgtttcactttgttgcccaggctggagtgcatggtgtgatcatggttcactgcagcttcaaactcccgggctcaagggatcctcccacctcggctgccccagtagctgggactataggcacatgccaccacacctggctgattgt

SEQ ID NO: 93332 - DNA, 455 bp, Homo sapiens
aatctattgataatattcaggaagttttacattctttctgggcacttaacattcttagttattttaattttttttgtgaacttgacattttatttcttaattcattttagccaattgtgagaattatgcattaaaatgggagattggcccctttccactgcatcacagatgaaaaatggaaagtacctttgattggtcccctcccacaagcaatcactggttgtgggccaagtcttcatgtgtaactttgttaacttcactttagcctctgattggttgactcttgcaaccaatcagactagttgtgggccaaatcttcatttatagagggtataaccaagtaaccaatgggaaacctctagagggtatttaaaccccagaaaattctgtaaccagtgcccttgagctgcttgcttcagcctgcccctgctctgtggagtgtactttcatttcca

SEQ ID NO: 93333 - DNA, 366 bp, Homo sapiens
acattagaaggggtttgtttctagggtttctaaagctagaaactcctagaaggtttgcagccaggggacaacaaactgtagctatctgggcccgcaaacaccaggagcctggattagagcatttggcaagggaccctttcatttgcagacctcacaatactccgattctttcttgcatgtgagcgagaacaacaccgaggtttgtagaaggaaagctctagaacaaaattcatcccgatgccagaggcttcctcacaatgtgaggagatggcgccccctcgtgtcgagatgatccttcagcacctggaccaggctgagagcggtgaccttgagcactaagcaggtggtggcttcaagatgggcttg

SEQ ID NO: 93334 - DNA, 499 bp, Homo sapiens
ttcatggttcaaggagtaggtagacatatttattataattacacgattgttaacaatgtgtactgccatccaaaaatgaacatttattgctactttgttcactagcataaagatgcaatttacttacatagaaaatattttatatgctttgatactgccatgtgtaaacattcttatggatatgtttgtgaactaaaattgacaaatacatattcctatgttaccaacttaagatcataaaccattctcatgtctgctcattaaagctaaagggtctattacatgtgaatctcaattatttttatagaaacatcacacttgattaccattttctgcatttcagtggttgctgtttgtattgaaaacaaactgagaaattgagaaatcaaatgtagtacctctcttaaaaagaggaattgttaacattaggaactaaactgccaaaagttattttccataatgactagagtcagtcatcacatacacaaattattattta

SEQ ID NO: 93335 - DNA, 361 bp, Homo sapiens
tgtcacagagtgtgaggatctcactgggggagttgtgtatccctgatttctggccgtgcttgcacttggctagcaaggcacacacgcacacagcagtgagccttccacagatgatggcctggtttccatccactcacacaggctgccctgagcctgccaggccccctgatagaacttgcctcctcccatgtcaggtggggcagcctctttagatgatatttgctttggatgggattgttgtacctattgagccagagaccattgctgtggtatatttgccacaagtcaggcacacatgcacataggtgcatgcattcacacatttgtcaggcatacttgcactcactcacaaacacacatg

SEQ ID NO: 93336 - DNA, 227 bp, Homo sapiens
tgaattgctgtgaaagttggtcttttaagctaactgtcaagctggttaatcaaactcttaaatagttcttctttcagtttcttatcctcatactaagaacatctgtaactgtttttgtctactactgtaaaagagaatacgaaaagacaaatgtaaacagggttaaaaaaatctttataaatattaaatacttattctgctagtaagctagagataaaccctgaaaa

SEQ ID NO: 93337 - DNA, 405 bp, Homo sapiens
aactctcgcatctctctgggtcttggaccctctgtgacaaagcagtggtaacttggtaactgtcttgggagcacgcagagagagtcaagcctcatcttgccaaattttcccagagtatgcaccccttcttcatctcctctgggcctttaccttagaagagctgtgtcatgcattactgatggcagaggctgtctgcattggagatgagtggctataatctttcatcaccttcaggagaactgtgaaatcgttgacttcctttatctgctcgggtttgagatgagctagcatctaccagttttagcctctggagtcccatggccttgtaagaagggagtgttctgctggcactagctgtgcgggggacagtagtccttgaccctttgttcttttcactctgccttc

SEQ ID NO: 93338 - DNA, 303 bp, Homo sapiens
cagcttttgaagatcttttggagtttcctgtggatttaatgtaataggtctgtctgtccttttgtctacttcctcctttctacttctcctctgcttttaaaagtggtagaaaagaagaaaaccaatgttacatagagatagaaagttgttgtgtgaggggttctataagtcctgcactcagtatgtcagtttaatgttctgtggttgttctttcttcactggttccttttgctgttcttggaattacaaaggattgctcctggtcatttaactcttcttagcaccctgatattagcacatatg

SEQ ID NO: 93339 - DNA, 494 bp, Homo sapiens
  misc_feature (296)..(296): n is a, c, g, or t
  misc_feature (305)..(305): n is a, c, g, or t
ctttttggagcactaatctaactccaaaggggtacaacaacctcatcacttctaatatgaatacaaccaagatattgtgtgagctgagagtggcagaagaaaactggaaaaagctctctcttagatagccagtgtcacttggagaagtctattcttatgtaaaaggagttatattggtcttctaagaagaaaggttgtcaggaactggcaagcactaaaatgcctaaccaacaccttggagttagagcagtctagttttagaaggcagagactaggagaattacttgaaccagggngcggaggtngcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagacctgt

SEQ ID NO: 93340 - DNA, 756 bp, Homo sapiens
taatttttgtattcttagtagagacagggtttcaccatgttggccaggctggtctcgaactcctgacctcagtgatccacccacctcggcctcccaaagtgctgggattacaggcgtgagccactgcgcccagcctgcatttaaattctcaataatttgtagctgctcatttctgaattttcaattatgaagtattttgctatttagaaatgttttaaatctgcacagttctattcagctcttaacacctgcagcctccagtattttctcatgttcagatatgaaggtatctgagctgtttctctatcagaagaatttatgtgatacatagagaatatgttccagtgatgttttttacagtgagttgtaagaatataatagaatcctcaggaatctatttcagtgtatcattatttaatggttagtatatcatgatttaatggttttttttttcataacctaataacgtacctaacacaacactcaaggttagaaaagatataataggtgaatattaaggataagaggaagtagacaagaaagagccctattaagatggggaagatggaagaaggttgtgacagtctcagtcagacttcttagaggaaacaggagcctgtcccttctcctccatgtccatactagcctgctgaatcctttacttacaggatcagctgaatatgtctagttgactcaagggtctttttctgcctccctctgttacagctgtgttacctttttacatagcaaagcaaa

SEQ ID NO: 93341 - DNA, 936 bp, Homo sapiens
  misc_feature (310)..(310): n is a, c, g, or t
  misc_feature (373)..(373): n is a, c, g, or t
cgattttcttagtattttctttcttttaagtggataagagttttgttgttgttcttgtagtaattcctgcaacggaggtaaatcctaacactcataaacacattaacacattaaatatatgtattggatactgagtatacttatagtactgtgtacacttttctctacaatggatgtcagatatacattgaatagagcagtggaaaatgggtatggtcgctctgctttcatagagcttctagtctagtatagaactttaaaaaaattatcatcctatccccttatcctacacagattttaatttaagtanttcattttaattgaaaggaactcatatctttcttcagaaataaaattcacccttgaaaacacnctgtttgaaataatataacagataaaattaaaaattagttgcccaagtagggctatcattgatttattttccagtgttttggatggggtacttaaggtctgagtttagcataatataaacacactgtaacttattctttttaacaaaaatactgaaagtatcctgagatcatctgtggtaggcagaataatgacaatgacaccccccaaccccccaacaaagacatccagatcctaatcctggaatctgtgaatatgttagattacacggcaaaggagaattacggttgctaatcagctgaccttgaaatagggagattatcctggattatcagggtgggcccactgtaatcctaagggtccttaacagcagaagaggagtcggaattccgcaggaagatcacctgaggtcaggagttcgagaccagcctgaccaaaatggagaaaccccatctctactgaaaatacaaaattagccgggcgtggtggtgcatgcctgtaatcctagctactcgggaggctgaggcaggagaattgcttaaacctgggaggcagaggttgcgc

SEQ ID NO: 93342 - DNA, 562 bp, Homo sapiens
caacatctcctgcctcagcctcctgagtagctgggatttggcccactaccacaccgggctgattttttggtattttaagtagagacggggtttcaccatgtggcccaggctagtctcaaactcctgagctcaggtgatcctcctgcttcagcctcctgaatagcaggaccacaggtgcatgctattgtgcctggctaattttttaatattttgtagggacagggtctccctatgttgcccaggctgagcgaacttattttacagaattgaaacttgtaagtggacagagtagggcaacaatatacatatgtagaatcctgaacctcgaacttccaggattctccatcaagtatgcaccatattgcagagagtgcctcctactgatgataggtggtatcacagcctggttctatgggacattttaaataaccaaagaaaaggggaggggaaacacaaccaagttctggaagtcccagcactctgtgttgagacctgcgggcctggaaagaagccacgtgaaacacctggaggcttcgggaggctttgctaatacaaaggagac

SEQ ID NO: 93343 - DNA, 572 bp, Homo sapiens
tggagaaatcctgtctctactaaaaatataaaattagctggacgtggttgctcatgcctgtaatcccagctactcaaggctgaggcgggagaatctcttgaagccgggagacagaggttgcagtgagccgaggtcacaccattgcactacagcctgtgcaacaagagcaaaactccatctcaaaaaataataataataataaatgaggaaaatactgtaatattatttgattatggagacctatttacaatctgactgttcagattgaatagttgtgaccaaacctggaataacattaagaaatgttcaaaacctgttttaaaaaattaagctgtagaaaggcctgttgtaatacaaatatcacattaaacaagagtaaaactcactgaaaggtacttgtgtgataagtgttgaaaagttgggtttttgtggggtttttctggggagactggaggcagggtcacactctgtcacccaggctggagtgcagtggcatgatctctgctcactgcaacctctgcctcccaggcttacacaatcctcccacttgagcctccctattagttgggact

SEQ ID NO: 93344 - DNA, 519 bp, Homo sapiens
tggagaaatcctgtctctactaaaaatataaaattagctggacgtggttgctcatgcctgtaatcccagctactcaaggctgaggcgggagaatctcttgaagccgggagacagaggttgcagtgagccgaggtcacaccattgcactacagcctgtgcaacaagagcaaaactccatctcaaaaaataataataataataaatgaggaaaatactgtaatattatttgattatggagacctatttacaatctgactgttcagattgaatagttgtgaccaaacctggaataacattaagaaatgttcaaaacctgttttaaaaaattaagctgtagaaaggcctgttgtaatacaaatatcacattaaacaagagtaaaactcactgaaaggtacttgtgtgataagtgttgtctgtcacccaggctggagtgcagtggcatgatctctgctcactgcaacctctgcctcccaggcttacacaatcctcccacttgagcctccctattagttgggact

SEQ ID NO: 93345 - DNA, 247 bp, Homo sapiens
gcacattgctggctgcgattgatgtttaaagagtgttcttccttttccttattcataggcataccatttcctttctgtaacacctacaggttttaccagtgcagatcaacaggagctctaatagcaataccacctacaaatgagtacatactgtgagccagtcattgttctggattcttcttaagcattatttcatttaattctcacaatatccacatagtgtagttattctgcccattttggggat

SEQ ID NO: 93346 - DNA, 579 bp, Homo sapiens
tacattgatactaaaagcatttaactctattgtaattaacataaaaccataaaagcttgttttcatttatctgtcttgattgtatcaaaatggcaaattcttgataagttattctgaaatggatcttcatcatgttaatagcaacaagaaaactccattcatttgtggttttggcttcaggatatatgaaattataatgaatttaggatttttttcctgtatcactttgataattttataaggtgtggaactgaatgtaaggaaagaaatacagcgtctagtggattcacattcatttccgtcttttaaaaatattcatacgcaccttagtcttggctcatatggtcattaaaaacttttttttgtatgaaaactatgaaaggaatataaatctgcatttcttccaaaaaaagtatgtgaaatcttctaaacaaaatatcattaaaaataatcttatctttgtggaaagatagtctaattggatatcttatgacaagttattgcaaataaattttacctatcgacattagaaaaatgtttttaccattacgtcatgtttctttaccaatcaacctctgt

SEQ ID NO: 93347 - DNA, 302 bp, Homo sapiens
gaaggggactttacgtaatcaaatttactttcaccttgttttctacaaatggcttatgcataaagcataaaacaacagtgggttttaaaaattgatacatgatattttacatattcatggggtacatgtggtgttttgttacatggatagaatgtataatgatctagttgggttatttggggtatccatgacattgagtacttatcatttctgtgtttggtgaacattttgagttgtcttgtagctactttgaaatacacaaaacattgttgttaactatagtccctccactctgctatcag

SEQ ID NO: 93348 - DNA, 335 bp, Homo sapiens
ccttgaaacatacataagcatatataaggttaagacttgccccaaatcactcagatgtctctcctctaaaatcttgatggtttttcgtgcacacagaataaaatctaaactccttagcgagaccctccatgatctgaacttcacatcttgtaacgcctacccctcgcccgcaaaagcctatggttcagccagacattttccccagtcttcgaacacactgttcttgtcttcccacatcttcatgccttagcccaattccttggctttttcccacctagttttctggtccaacttctaccatcctttaagattcagttcaaatgtcactttctttc

SEQ ID NO: 93349 - DNA, 275 bp, Homo sapiens
ctccagggcatggctcttaacagctgtgctctgactgcctcagaatgtatcattcatctgtgtccattgactactacagaccaaaacacatttgcaacttcttgtcacctctgctgctagtgccttggtccaaacctccatcgtgtctctcttggatcatgggaacactctcctaactggtctctgtattttgcccttgaacagaatgcatgtattatgtttttaacattttttagtaattgactttctgacactcctctattttatttattata

SEQ ID NO: 93350 - DNA, 219 bp, Homo sapiens
cagaggaataaagaaaaaaatttgaaaatcatttctgcttgttgtacaactctaaaagcatctttgcattaaaaaaatcttcttctgaataaaagtttatgtatacctatcagtaaaatttctaacagtatagaaatgttaaaaaatcaatagaaaagcgcaatttcatagcagtttcacctcctagatagtcaccattgttgacagttcggtgcatgt

SEQ ID NO: 93351 - DNA, 160 bp, Homo sapiens
ccaggaacggttctggaccatcacttccagctactaccggggggctcatggcttcctcgtggtatatgacgtcactgaccaggaatcctatgccaacgtgaagcagtggctgcaggagattgaccgccatgccagcgagaacgtcaataagctcctggtg

SEQ ID NO: 93352 - DNA, 376 bp, Homo sapiens
ttcttaccatctccccattgcacagaaaggatggctgtggctcaaagaggaagtgcctttccatttgagttctgctgctagctcagggcagacctaggacttgccctctgaccttactcctgctgtgtgactccccagctgcacctctctccatccacgggtcaggcctcagttgaaccctggtggggtggtgggggctcactggcttcacaaggccctgctgtggtagctcttcccacctcattctctcagtgctggtttgcccagagctgtggttccttcttcctggcccctggtctcatctccactctatcatatccagcatctgcctgggccacctgcttttacttctttaagccagggccattttcttggc

SEQ ID NO: 93353 - DNA, 246 bp, Homo sapiens
tcttcccttcccttcttgcttgcttgacagggtctcactctgtcacccagcctgaagtgcagtggcatgattatagccgaatacagccttgaactcctgtatttaaatgatcctcctgcctcagccttctgagtagctaggactactcagtgtggtgtttgccaccacactgggctaatttttgtttttaatattttgcggagacagggtcttgctgtgttgcacaggccggtcttaaactcctct

SEQ ID NO: 93354 - DNA, 250 bp, Homo sapiens
cagatctgcatcgtactgctgcatcggagtgggctgcttccattatcccattcttacaccactgtcaatagagatttctagtttctcaagatgggccatatcttagaaaaactgttttgtgtttcttattaagaatttttcctaagaactttattagaggcagctagcggtcttaccagaaaagacttttcaataaatactgagatttgtttttcattatctctttctctttacagtgggcttctcattt

SEQ ID NO: 93355 - DNA, 612 bp, Homo sapiens
cttaaactcacgaggggctgcattcacaccatcagcagggagattacacttgtgtcatttgtgacactagacaggtcagctagcaccatcaagtacttttttttttatatgaactgctattgtgctaggcctccccaatcctgtacttgtgaggttcatttctttgaacccaaatacagaaattcctgtttattccttttgcaaatttgattattcagcctcttgggagaatttagattccaagttctgtcagtgagtatattagccattcctctttggctgtcttagccattcaaaagtgtgataaagatgcttccatatgacatattgaatgaagtatcagggccaggatgtcctgaaaaataccttattgaggacacagcataaatacaggagcctgcactccactcaccaaaatctaccatatggtgattcacatttcatccaccaaaatatcatgaaaaatgaggtcacaggcctcggtgacatcaaaacacttttaaaatctatatccgtttccattctacttttcttatgacccaattggggcaaggggaaagttcttgctactcattgaccatttgctaagtatttctaattcatcagatcaaa

SEQ ID NO: 93356 - DNA, 500 bp, Homo sapiens
gccacgggctgattgggactgtcgggtgttgctttaagttaacaaggtgcacatcacagcgaccccaagtgatgtcccaaagggaggagacattagtctggccgaagtgaagtctgtggctttatatgtaaaagcactcgtatgcaactgttacctttgaaactcagatcctagttacgaactataagaacgtgcccctccagtagagggagactgtctcactgatgttgatttctttattcatttccgcatctgttacacgaacttcgtgtcataaattgctatcctttcatttgaaagtgtaaaaaatttcctgcatttttatcatttctgtatacttgagtttattagagattgttatgttaggcgacactgtataaaattgtatggatattttgagtgaaaatcaaaagtaaaattcacatgtatttccttttttatattttcatccaatttcttgacaacttgaataaatttcataaagagccttcctaacatga

SEQ ID NO: 93357 - DNA, 370 bp, Homo sapiens
ttttggagacagaattttgctctgtcgccaggctggaagtgcagtggtgcgatctgggctcactgcaacctctgcctcccgggttcaagcgattctccctgcctcagccctaccgaaaagcagggattacaggcgcctgcctgccatgcccggctaatttttttggtatttttagtagagatggggtttcaccatgttggccagcatggtctccatctcttgacctcgtgatccacccacctcggcctcccaaagtgctgggattgcaagcgtgagccactgcgcccggccactaataatttttaaaagcccctagaactaccgtagcttctaaaaagggaggaaaggaacgattcacaagtattgaatt

SEQ ID NO: 93358 - DNA, 1835 bp, Homo sapiens
  misc_feature (17)..(17): n is a, c, g, or t
gggtgcagtggtgcganctcggatcactgcaagctccgcctcctaggttcagaccattctcctgcctcagcttcccaggtagctgggactgcaggcgcccgccactgcgcccggctaattttttgcatttttagtggagacagggtttcaccgtgttagccaggatggtctcgatctcctgatctgcccgcctcagcctcccaaagtgctgggattacaggcatgagccaccgcgcccggcccaggcacttaatttttgtgtttgacttagtaacaagtgcaaactattacgggagcagatggagtcaattggccttcatgtgactgtcagtgggaaattggtccaagcagagggaatactggttcaggaaactggtttgggaaggttaggcaaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactgccaagctttgaatagcctgctgtgttcatggaggctcatactggcgatctctagtggctggctaaagcttgaattgcaaaagatctaatttctggtctaatgtatatatgccttaaatatagttgcgttcaaacgtgggagctgcaggtgcaacttgattttatgacaaatgtctgccacataatttgcacaagcagtgctcgtcaagggcagctaaatcaggcgagctttcaatcaaaataaatgtactactaaaccctacttagcggctaactagcccaagagcagacagcccacggacggactgcaagtcggaagcgcgggcggaagctgtgcagcgcccacctggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccggcctcgctcggccacttccggcaagggcggagccggccagtggtgcgcgagcgcagataactcccctggagaggcgggatgttcaactccacccctggtccttgggcggccgtgggtccccttcgaagcggaggaatggccaacctcgccgcacttcgagcccctttagggtgcgtttaagaacagtgggcgtggcctttacgtaaatcttcgagatgggaacctccagaatttgtctcaattgtctaaaaggtaatgagcgtcagcgacattcaagggcactttgggctaaaaaagaaagtgcttgtacacggatggaaatattctagaagaacataaaaggaatttcctcttaggaggttagggaaatgagcacgaagtatgttttggtgcagttttttgttcaacccaatgcgtattttcatattgagaggcaatataaatggagcgaaagtatcttgag

SEQ ID NO: 93359 - DNA, 2210 bp, Homo sapiens
  misc_feature (17)..(17): n is a, c, g, or t
gggtgcagtggtgcganctcggatcactgcaagctccgcctcctaggttcagaccattctcctgcctcagcttcccaggtagctgggactgcaggcgcccgccactgcgcccggctaattttttgcatttttagtggagacagggtttcaccgtgttagccaggatggtctcgatctcctgatctgcccgcctcagcctcccaaagtgctgggattacaggcatgagccaccgcgcccggcccaggcacttaatttttgtgtttgacttagtaacaagtgcaaactattacgggagcagatggagtcaattggccttcatgtgactgtcagtgggaaattggtccaagcagagggaatactggttcaggaaactggtttgggaaggttaggcaaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactgccaagctttgaatagcctgctgtgttcatggaggctcatactggcgatctctagtggctggctaaagcttgaattgcaaaagatctaatttctggtctaatgtatatatgccttaaatatagttgcgttcaaacgtgggagctgcaggtgcaacttgattttatgacaaatgtctgccacataatttgcacaagcagtgctcgtcaagggcagctaaatcaggcgagctttcaatcaaaataaatgtactactaaaccctacttagcggctaactagcccaagagcagacagcccacggacggactgcaagtcggaagcgcgggcggaagctgtgcagcgcccacctggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccggcctcgctcggccacttccggcaagggcggagccggccagtggtgcgcgagcgcagataactcccctggagaggcgggatgttcaactccacccctggtccttgggcggccgtgggtccccttcgaagcggaggaatggccaacctcgccgcacttcgagcccctttagggtgcgtttaagaacagtgggcgtggcctttacgtaaatcttcgagatgggaacctccagaatttgtctcaattgtctaaaaggtaatgagcgtcagcgacattcaagggcactttgggctaaaaaagaaagtgcttgtacacggatggaaatattctagaagaacataaaaggaatttcctcttaggaggttagggaaatgagcacgaagtatgttttggtgcagttttttgttcaacccaatgcgtattttcatattgagaggcaatataaatggagcgaaagtatcttgagaaaaaaaaaaaaactaccagaacttgccgttgctgaaaagtaatattttctctttcgagagttttcatggccttttaaattacacccccacctccacaggcaaataaatttgttttggaatgcataccacatcatctggctctagaaacgtattttgtgtagctcccctagcaagaatataggttaaagcgtaaatttaattcctggctctattttacatcccaatttttattttcctctcattcccactttacgttgtttcaaataacctagtttgtgtatccctgtaagtcattttggtataaagtaggttataagtgtacatgcgaaaagatgtttttaacaaaaatgtaactgagctgtgactaatcccac

SEQ ID NO: 93360 - DNA, 219 bp, Homo sapiens
gtggagaaccgcaggagatgagattggaaagtagtaataagccatgtggataagaacagaggagcgggttttaagggggacgtcctgaaatgctgctcatgtcgtttcagttccatagaccacaggaaatgcaggtgagagggcagcccggtgggaaggaaggaagagggtggtggtgagccaggtgagtgtggagccgcccagggcaccgtgctgtgc

SEQ ID NO: 93361 - DNA, 291 bp, Homo sapiens
agatttttaagatatttttaatcacatcatttgacatgtagtcagtattagtggtggcttaatgcattaatcagttatccctagttccaaaatatgcactcgaaaacaagaagtatttgtgtcattaatgaaaagagcaccttgggagtcagagggatttggttgccagtcatgccagttgttaacccagtggttctcaactgggggagttttgtcctccctgccttctccccaaggacatttggcaatgtccagagtcattttttatcgtgacaattggatagggggatt

SEQ ID NO: 93362 - DNA, 275 bp, Homo sapiens
acacagtgtgggggatttgaggaggttgcacacagtggggggacttgaggtggcacacagtagagggatttgggggggttgcacagagtggggggatttgagaaggttgcacacactacgggggatttcgggaggttgcagagtgggggaaattgggcaggttgcacagagtggtggggatttgaggaggttgcacacagtgggggggatttgagattgcacacagtggggggatttgaggaggttgctcacagtggggggatttggggacattg

SEQ ID NO: 93363 - DNA, 630 bp, Homo sapiens
ggctcggtcccctcgcgacgtgtatccaggatggtctcgatctccgactcgtgatctacacgcctcggcatctcaaagtgctgggattacaggcgtgagccaccacacttggccagactgcagtgttattggaggctgtggtgaggctttgctgaggatggggatgccaggaagtcttgtccttcagcatcagtggtagtggcggtggaccaggtgtgtcaatactagggaccatgggcagcgtttgtgggcactgatgatagcctgtctgtgtgggccaatccctgggactccaggtggcttctttggttgctggcagtgggccagatgggcaggtgcaccactgggctcctgggtggtgtgtgtggcaggctgatctctagttctccaggtgacctatacaggttctggtggtgggtaggcaggcgtttcctcaggcctctcagtagtaagtgtgagcaccagctctggaggcaggtgagtcaatctccaggtccccggatggtacattcaggcaccagcatattcctatgcatttctagataaaagtatttttcagaaaacctgagcatatgtcctattaatacaacttaccctcatcagctctgcatgagaagaaggcggaattcc

SEQ ID NO: 93364 - DNA, 1119 bp, Homo sapiens
acattttctaggttgtttttatttctacaccattattctgggaattcttccattgataactagaatattcaacagtttgcttagcattaaacagtgtgagatcataaccctgtgctttggactttattcttctagacctgccattccaggaagtgccagaatataccaaaataaaaatccccataaaagcatttttaaacaaaaatccctgggtaatgtttgagttattttaaatctagatcaaaatcttggattcttctgagtccatgatgacaaatgtttggatgaaaagtagaaaatacagttaaaaataaaaatgtcctaaagtttacagatttttgagtttgtgtacatatcttcaaactcactccttgcatgatagggttggttttaatggtttatttttatcagcaccaagttgcattgcactattgaggctgagcaaatgctggtggaaaggtgagttttcatttctggcaatggatcattatttgtacactgtaaatatcatgcccagctacccctttcccttatctcttcccctgggataaatgttaaggaatagtaatacttattatggtatgtttaagaaaccttggacattaccctgaatcaaaacttcaaatgttaggtggcagcaggaaacaaaagattacagcttgaatgaaattttaaaattgaatgttgtaaaactatttttgaacgttttagctgccttatttatgttaatataactgtagagagatgccaaatgtataatatcagaagggaaaactacgattttgctgtgcctacaattgtttacattttttaaatctccagttttcaaaagtattttaaattgtcaaacatttgctaaaactggattataacctcacctgagaatgagagaagaaaatcttcctggcatattttccagtctgaaacttttggttactttcaggtattttttttcttgcatacaaaaatcattgagaaagtactttctacagttattctaagcagtcattaaaaatgctttgataggtttccccacatggtaactaccatgtcctggaatataatatgctatctttgtcaaaatatgaataataaaacattaatcgtaggatgcctcct

SEQ ID NO: 93365 - DNA, 370 bp, Homo sapiens
cctagtgcaggcaagagcttagtccaagccaatgacagtcccataaatttcacttaacacatgaaaatttccctcctccagtactctcctctagacacaatcattgttatcatagaaattctatggatatgaaatatcatatatatatatattttttttttttttttttcacctattgaattagaaaagccatgaactggcccggtgcagtggctcactcctgtaatcccagcactttgagaggctgaggtgggtggatcgcttgagctcaggaggtcaagaccagcctgggcaatatggcaaaaacccttctctaccaaaaaatacaaaaattagctgggcgtggtggcacacgcctgtagtcccagct

SEQ ID NO: 93366 - DNA, 429 bp, Homo sapiens
aatggctggtgtggggtgtcctgagtacctgagtgtgcataaaagctgaccctggggtccatgggcatagcagggtgggagctggtgggcccgaggtggggatgagaggggaggagggaagtggggagaggatcagggagtgcttctgagaggccaggagaaagaagggcacaggagctccctggcaagtctgggcaggccacagccctgggcatttgggggacaggctgggggtgggcaggctggggcaggccgggacctggagatggggctgcagacggtacaggcctaggcttgtgtccccagtcctggcgggctccactgaagccccatcacccccagctctgccagtgcctgcagggagaaagggcgaggtttgggaacaactggctcctgctccccatcacaccacctgggtacccctaaagc

SEQ ID NO: 93367 - DNA, 712 bp, Homo sapiens
gggctctctttagtcctacatactctcttggggttttgtgattctcttaaaaccttaagtttccaccttaagatttttgtagactttcctttgggatttagttgtgacagggtgctgaaaatgcaaaaatatttgtgtcttccatattgacatacttagataaattagattggtttggggaacactgaagttacagaatggaaaaggaggaaggaggagtgcataaaagtaaagaacatttttgagataactaacatttgttttttatagctatttattttcctggggtaaaagaaaaattgtgacaagtatcctagaagaaattacaagttaaaagaacaataaccatatcctctattcttagtttctgatgctttgttttaaaactttgcctttaccacttatatggtattaggaaataaaaaacatggtactttgttctcctgcttcctagacgaaatctaagcaatattttatccacttctttttagtaaaagaaatacatattgcctgttggggtcatgagctatgtagggaatgaaaaaattttttaaaggagaattataaagagaaggaggatacaagagaaaggaaaacgaaagctggtgggaagttgagccatgtttatctctagtggaatccttaccttgtgttttaaaattgttaaatgtttgtatatatgagaaatccctgaaaagttatatgtaattta

SEQ ID NO: 93368 - DNA, 448 bp, Homo sapiens
atatatatatatatctttataccagatctatatgtacacatataatatgacttacatcatcaccctctgaccctatcacattcaggattctaaagcagggagcatcaagtttgccaaagtcaaggaaaaggaaagtcatgcacacaaaccaaagggaacatttcttcctgatttcataaggttgtttgttccatgcacatatatttacaaatatacacatatgtacccatattttcccaccctaagaatatcaatttatagccttaaggaaatcggtcagccatatccctaatgctgatatagaggcaaagaatacacaacagaaaatacaaagcaaaaatttagactgcagatactctctttgcttctctggagcagggtataaaagatatcaacaattcaagagccaacattgtactaatcaatctaaaataaatgagttgcacgc

SEQ ID NO: 93369 - DNA, 782 bp, Homo sapiens
tccctcccaggaagtgtaggaatcatccaaagtggtaaaagagcagcgcttctaaactctgacttcacatggaaaataacgcgactactaaaactgataacaatagcagtccatgccatttgacaggggtgtgtaggagaggtggtgagcaagctgaaatcccttcaggtatttgcagaacttctgagcaaaagctaaagctaaaattaacattaaatatgcaaagtatttttaacccaacataaattaacaatgttcctatttcaattctattgctcttgggatgactatgtcctttggaaaatgtttaaataacttaagatttccgtcatgagtttactatttcaaaacttatttttttaacagcaagatacctttttatgttaccaggagtgttaccagctagctgccaaaacctggttgaagttctcccactttatattgtaaatgattacatagtttattagtaattgtgtcccctgtccacccactggtccatttggatgggaaaattttcaaaataacttcataagaaaatgataagaaaaatgtggtcaccggtatcatgaggaacttccagacagctcagcacagaaaagttggttttaaagtcctcgaaaacgttactggtaatgagcttccactcctttagtcgttgtgcatagatacaccacagagtaaggttataaaaataaaagttgtttcaggaaatttcccattgctttattacatgatcaatgagagtaaagagaaatggaagttgacgggataggaatgaggga

SEQ ID NO: 93370 - DNA, 544 bp, Homo sapiens
agtgtaataaggagggggtgttgccttaggcttccacatcatctggctctcctctctacagcaagcctggttgcccctcagaattacagcaaccagaaagcaagcaaggacagccagggaaggcaaagttggcactgtgctgaacatggcttagaactaggggctggatggcctccttggttttgtaaactcttaaatttatacttgtcagtggtcttccctaccttagcctactggtctatataaaatccaaatatttagggggagagggtggaacaaacagatctgagagtgagaaatggatagaatcttaaaccagaatacaacctcaaaggactttgaaaagaacaactctgaacacaagggagctataatcaagttctagaaaataagagggataaaaatccaaatattcttgataatggttcctctgaacattgacctatattatttgtttgtttttcagatagggtcttgctctgtcacccaggctggagtgcagtcgtgcaagcatagctcaatgcagcctcaaactcctgggctc

SEQ ID NO: 93371 - DNA, 416 bp, Homo sapiens
aggtctgcatgggcccggcctcggcctcacagcggactctccacgcccagctagctctcgcctcactgcaccctccccagtccaaagctcctgcctttcggccacttcggcaggcccagctcctgcctgccagtggcctctttaggcccagctcattcctcacaacggcctttccaggccccgtttttcccttccggcagcctcttggcctctaatttttttatcttttgtgtataaatcccaaaatatggaattttggaatatttccaccattatataaatattttggtaggtaatttatttggagtgagtttctgcaccaagcccgaattttttattttattttccttattatttggtgttaaacaggtttaatgacggtcatggcaactttttggcacaatgaaaaatatcgc

SEQ ID NO: 93372 - DNA, 454 bp, Homo sapiens
cttagttcctcagttccccgcccttcagcttctctttgttagccactgggtgggtgtaaccaaacctcagtcacactgtggccccagcagctgggcttctctctcccccattacattgcagacattcttttcacatcattttgtcctctctgctgcattccctacatttggcttcattccctctgtgcaaacttctgtttcaagggacagcagtttgccaaggagatgctggcagagagggtccagttctttcctttctatctgaagagcccagtgtcattcattagcatatgagaagaatggttgtaaataaacatcaaatgaggttaacgagctgcagctcatcaatattaatgaagtccacctcacagccttggtatgaggtaccaatggctctaatcacaagaagcagtttcataaggccccagttacagggcaggaagggttagatcca

SEQ ID NO: 93373 - DNA, 248 bp, Homo sapiens
gtgtgagccttgggagacatctgagctaaagatacagatgtggctatctttgcctgtaggtgggctttgaaaccacaggtgtggatgagattgtcaagtgtgagggtgtggacagtaattgacccctaaggctggtagacagtgaggagctggagaagtaggaggaaaatcaggccaagggaagtggtcagctgtgttaaagtttgccgaaggtaaaagaaagaatatgaccaatgccaaagagatgt

SEQ ID NO: 93374 - DNA, 296 bp, Homo sapiens
tatcacacatcaatgtccatttaaaaaaatgtgttgccatgaataagaaaatgccacttttaaacattctttagtaacaaggaaagaaatataaaaatcctttatccccatgaatggtataaactgtcattggtgtaatgtttgccaggctgaggctgcgtcttactgtgcttctctgagttaaggaagaagattggggttaggttattggttgattgtgaagaaggtgtaatgaggaatggccatggcaagagaggcgtaaacaagatagacaatggtgtctgtgccagacagag

SEQ ID NO: 93375 - DNA, 346 bp, Homo sapiens
attaaagaggtttaaatttgtctatatctttattttaattgtatatcaataatttaattcatataaaattattccaattatactattatagaggactgatgagataaattttgtataatatattaactctaccctcagtctacaatcaaatagtactttccttagatgtaattttgcttgtgagaaatttgctgcacaattccattttgacttttaggcataatagagctaagtcacttgagacactttgtattaaaatccttcaagctttggctatctagagattagaaggacccagaatggaaacaaggcatactaaagataaacacatctctactaaaaatac

SEQ ID NO: 93376 - DNA, 299 bp, Homo sapiens
atgacagctagctccattctctctctttctccatagtaaaccaagcctgtggactatgtaatagaaagacatccttctcctaaaattccctttatggtttcaggaccataaattgctctcttcatatgtagcatatagcagttatactgcctgtatttctcagtaagtgctactgaaatttaaaataagctgcattttaatgtctacattatgtgagcattacatgagaagtgtgtatgttccaatatgcattagcatgatggactcacacataggtagccatgcatctgttctatatt

SEQ ID NO: 93377 - DNA, 426 bp, Homo sapiens
ggggagggagagggagaggagaagggagaagggttgggagacggaaagagaggaagggggagggaaagaaaaatgctaaagggcaggaaaagggaagtctcattttcttgtcttatttcatatgaataggtaactggttaattataagtcacctgctgtgatccacatgggaactccctgccaagtggctgctgccttctagatggtttgtactatgagttccatgcaaggtgactggcatccatttcctgcctgcctcaccctgtaattcctcaaacttactgcggtaccacctttaacactaaggaaatgcaaacacggcatggtggactcactcagtgagttgacagaagactccaaatatctgatataaggctccttagatcactttgcactgaaatctcaaattattattctcttccaatt

SEQ ID NO: 93378 - DNA, 253 bp, Homo sapiens
agaatattaaggaattttgtcttatgagaatgagggatttcttttaataagtaaaatgatattttcagaataacatgagaccacaaaacagtgtttaccatttcttctttgctctctatttgtagcagcgtggaaccttcctttaaacaattctcttgactggtgtgccaaatgctccaaatttcagagacatagtaacaactttctctgttctgaatccaattgtttggacaaggactgctgttatgggctt

SEQ ID NO: 93379 - DNA, 557 bp, Homo sapiens
gggattcgcccttaagcagtgtaaccacgcagagtactttttttttgtctcttttttttttccagattctggaagaagcaactgaagaagaaacagcacttcataatcgaattatgcccacagtggttcgtcctcccaaacaactgcttcctgaatctacccctgcaggaaaccaagaaatggtgagaaatcacttaaagctagataaaactgttggtggttacttatatttatttttaatttttttcaatttttattttttatagagacaaggtcttgctatgttgcccaggctggtctcaaactcctgggctcaaatgatccccctcaaccttggcctccccaagtgctgggattacaggtgtgagccaccacccccagcctgcttacttacatttaattctcattttgaaatgttgctagaagaggaagtcacaagtcctttatttaactcttatgcagagataggaatattttaactgcgtttatcagaaactacacctctgtgttgagatataattctcagtactatcacttttctttcctgtttactgagc

SEQ ID NO: 93380 - DNA, 371 bp, Homo sapiens
aactttagtgtgttaatagagttaatctgtactattttttcttgttttgtttcgtttttaggagctgtttgaacttccagtaagtgaagaatgtttacttcttactaagtatatttgttttgattctttaagaatattaagtgctttgtgcctcttttgaaatgatataggctacttatgagataggaattgttcgccagttcccattttcttctgctttgcaacgtatgagtgtggttgccagggtgctgggggataggaaaatggacgcctacatgaacatgtagcgaacttattacacgctccgtctctgttgtccttttgcaggtgcggcgatttactctgtctgcgcggcggggatctctctacag

SEQ ID NO: 93381 - DNA, 5724 bp, Homo sapiens
caactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataa

SEQ ID NO: 93382 - DNA, 5461 bp, Homo sapiens
gggattcgcccttaagcagtgtaaccacgcagagtactttttttttgtctcttttttttttccagattctggaagaagcaactgaagaagaaacagcacttcataatcgaattatgcccacagtggttcgtcctcccaaacaactgcttcctgaatctacccctgcaggaaaccaagaaatggagctgtttgaacttccagtaagtgaagaatgtttacttcttactaagtatatttgttttgattctttaagaatattaagtgctttgtgcctcttttgaaatgatataggctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggagaacttcttccttgacatggtcctttggaaagttgtgttcaaccgagacaaacaaggagagtatcggttcagcaccacacagccaccgcaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataa

SEQ ID NO: 93383 - DNA, 5903 bp, Homo sapiens
caactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataaaaaaaaaaaaaaggtttgggggggcgggccagaaagttttaaacattttgtgggggggccagaggtagagagtgctcacggtcccaagaaccgggcgacatgggggttcaccaaaaaaggctgggcggcgtgtgcaaacaaggggggggaagggttaaaaggcagcgcatcgccgggta

SEQ ID NO: 93384 - DNA, 1946 bp, Homo sapiens
caagggagcagtgtagcaacttcaaatctgtgttctctaactctgatatttaactccctcttatagagacccttgtgattacattgggctctcttgaataatttagaataatcttcccatcgcaggattcttaaccaaattacatctgcaaagtcccttttgcccacaccacctgagtccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataa

SEQ ID NO: 93385 - DNA, 5470 bp, Homo sapiens
caactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgcgagccacacgtatccgatatcatgatcattgctattcctg

SEQ ID NO: 93386 - DNA, 1458 bp, Homo sapiens
gtaatttttaagctgctacttagcaattactttcattatatgcttcagtacttaaaccaaagaataaaatgcacaattgtggaaatcactgaagaataacacgagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataa

SEQ ID NO: 93387 - DNA, 1305 bp, Homo sapiens
  misc_feature (23)..(23): n is a, c, g, or t
tcgtcggcccaacatcgcaggtnagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataa

SEQ ID NO: 93388 - DNA, 1064 bp, Homo sapiens
tcgatcgagctcggtaccgaatctcgaagtgtgagcatgtcaaatgtgggagtcgtcagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataa

SEQ ID NO: 93389 - DNA, 675 bp, Homo sapiens
  misc_feature (5)..(5): n is a, c, g, or t
  misc_feature (26)..(26): n is a, c, g, or t
cccgngaattcggccattatggccgngaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataa

SEQ ID NO: 93390 - DNA, 1833 bp, Homo sapiens
gggattcgcccttaagcagtgtaaccacgcagagtactttttttttgtctcttttttttttccagattctggaagaagcaactgaagaagaaacagcacttcataatcgaattatgcccacagtggttcgtcctcccaaacaactgcttcctgaatctacccctgcaggaaaccaagaaatggagctgtttgaacttccagtaagtgaagaatgtttacttcttactaagtatatttgttttgattctttaagaatattaagtgctttgtgcctcttttgaaatgatataggctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattgatctcttctttttgtgtattctaagatgctgttatattaacccaaagatactctacagagaataaagaaccta

SEQ ID NO: 93391 - DNA, 381 bp, Homo sapiens
ttatttttaaactgtaagtggaagaaccatacattatcgttactctgccagcccagtcatggagactgtagtagattctcagcaagtacatgtttgatacgttcacgtttccattttaatttcaatacatttaaaatattttgaaaattaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggtaaggtcaagatcgactgtccgttttaaagtttgttgatttaaatttagtctg

SEQ ID NO: 93392 - DNA, 221 bp, Homo sapiens
gtcatttcctcttatttttctctgctaatgtgtgctttaacaaacctgtttaaaacgacaagcctttaatcaactggggtgttttgttttgtttttttcttattttcttaggagtcagtggatcggtggggaaaatgctgcttaccctgggccctgggctgtagaaagaagacaccaaaggcaaagtacatgtatctggcgcaggagctcttggttgatcc

SEQ ID NO: 93393 - DNA, 840 bp, Homo sapiens
atttcagcatcagaaaaataatttttatatgtttcttatactaatatttcatatttatatatataattgtgatctataagatagttcagaactttaagtgccgctttaaaagagtctcatgtgctttttatttagctaaagtacaatatccacagttttttctctatgacttcattctttcaggtgctctatcttgatagaagtggctaatcattttagtaaacagttatgtttcaggttattaagggataaatttttactgataacgttaaaagtagccatactaaagactgtaggcacaagcgctttgctctaaagatgaggaaattgagacaccaaaatgatttgccgataatgtgacagaaataggacaataacctagctcatttcacttgtggtctggtgctgtttgcaaagcagcacacctgtgttcattatagtgaaaagattcatagttccactgggggaatcttggtgtgttagctctttataatactgtaatagaaaagtcttaataagttaaatgttttgtagtttaagaaattaattaaaatcttaacattgttttgtttcttagttattttgttgggatgtgtggtgatggcgcaaatgattgtggtgtaagtatagtttttgtgatttagttttatagttcttactctagcctaaatcatattcacaaaacttaaccagttttcttaaaattattaggctttgaagagggcacacggaggcatttccttatcggagctcgaagcttcagtggcatctccctttacctctaagactcctagtatttcctgtgtgccaaaccttatcaggtagtacaaattaaaattt

SEQ ID NO: 93394 - DNA, 5671 bp, Homo sapiens
caactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaattttaatgaatgaaataa

SEQ ID NO: 93395 - DNA, 3609 bp, Homo sapiens
caactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacaccgctcgaacggggaccctctgaaca

SEQ ID NO: 93396 - DNA, 2306 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggacgaagtctcgctctgtcaccaggctggagtgcagtggcatgatcttggctcactgcaacctccgcctcccgggttcaagagattctcctgcctcagcctcccaagcagctgggactacaggggatgtgccaccaggccgacgccaccaggcccagctaatttttgtatttttagtagagacggggtttcaccatgttggccaggatgatctcgatctcttgacctcatgatctgcctgcctcagcctcccaaagtgctgggattacaggcgtgagccaccgtgcccggcccaactattttttttttttatcttttttaacagtgcaatcctttctgtggatgaaatcttgctcagaagctcaatatgcaaaagaaagaaaaacagcagggctggacggatgttgggagtggggtaagaccccaaccactcagagcccacccccccaacacacacacacattctctccatggtgactggtgaggggcctctagagggtacatagtacaccatggagcacggtttaagcaccactggactacacattcttctgtggcagttatcttaccttcccatagacacccagcccatagccattggtt

SEQ ID NO: 93397 - DNA, 2001 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggaggggaatggattgtagatatttcaccaagaattgcagagagcatatcaagcatgtgaattttatgatgccaccgtggagaaagggtctagaatgctgatctccaggtagctggagacctaggcagtctgcaaatgaggagtcagctggaagctatggctatgtattatgtgacatcgcttgttcctaagtgaaaactggatatcccaaccttctggaccagtaggtttcatggttacgacctggtagtgagaacattttaggaactatttggttgggcaggcaatttttcactct

SEQ ID NO: 93398 - DNA, 1587 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattggtaagtcttgaacacccctcactttagcatctgggggtcttcaccctcctcggcttctgttaccccagactcccagtccgggatggaagaggaaggattagcatttcaaacagcacagctctagggcaattagaaaaggctcccttgtagagcactttttcgactgtaaagtggcttccaactgatgcagattaattggtctctttaataagaatgtcaacttttcttaatgcctataagcacgtgttcaatttaaatgcatctgctc

SEQ ID NO: 93399 - DNA, 2290 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatggggtgggtggtagacccaactcatcaggcagcgggtagggcacagggaagagggagggtgtctcacaaccaaccagttcagaatgatacggaacagcatttccctgcagctaatgctttcttggtcactctgtgcccacttcaacgaaaaccaccatgggaaacagaatttcatgcacaatccaaaagactataaatataggattatgatttcatcatgaatattttgagcacacactctaagtttggagctatttcttgatggaagtgaggggattttattttcaggctcaacctactgacagccacatttgacatttatgccggaattc

SEQ ID NO: 93400 - DNA, 2089 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaaggaatgatcatgaatgcaaagggaaagaggaaaagagccttcagggacaaatagctcgattttttgtaaatcagtttcatacaacctccctcccccatttcattcttaaaagttaattgagaatcatcagccacgtgtagggtgtgag

SEQ ID NO: 93401 - DNA, 1067 bp, Homo sapiens
cacagagagcctggtgggttccttccacaccacactctctaccccaccacactggctgccacactaacagggatgctcagagagaccttccacaatggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatggggtgggtggtagacccaactcatcaggcagcgggtagggcacagggaagagggagggtgtctcacaaccaaccagttcagaatgatacggaacagcatttccctgcagctaatgctttcttggtcactctgtgcccacttcaacgaaaaccaccatgggaaacagaatttcatgcacaatccaaaagactataaatataggattatgatttcatcatgaatattttgagcacacactctaagtttggagctatttcttgatggaagtgaggggattttattttcaggctcaacctactgacagccacatttgacatttatgccggaattc

SEQ ID NO: 93402 - DNA, 1888 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggaggccctccttttgtgccagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaaga

SEQ ID NO: 93403 - DNA, 784 bp, Homo sapiens
  misc_feature (594)..(595): n is a, c, g, or t
  misc_feature (598)..(598): n is a, c, g, or t
  misc_feature (611)..(611): n is a, c, g, or t
  misc_feature (625)..(625): n is a, c, g, or t
  misc_feature (638)..(638): n is a, c, g, or t
  misc_feature (650)..(650): n is a, c, g, or t
  misc_feature (676)..(676): n is a, c, g, or t
  misc_feature (724)..(724): n is a, c, g, or t
  misc_feature (756)..(756): n is a, c, g, or t
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagcaaganntgngatgtgaaaaagnagtgattatggggnaggggaaagtggntatggaagtggnaagaataataatgaaaaaaaatgagnaaatggagagaaaggaaataaagaaggaagaaatgggtgtaatgaggnagagtagagtgaagaaagtgtggatagtgggnaggagtggaaaaatgaaagtggaattaa

SEQ ID NO: 93404 - DNA, 778 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagtaggagcagggcgcctttggggctggatgggagcgcggggaggcctgcgagcgctgagtaggggtcggagcagagctggggcagggctggagaagggtgagactgaaggggtgtcttcctgctggcgagatcccggtggtgtacgggggtgggcggagatctgtgcgtgagatgtgaggcttctagggttagagacggaggtcaacaaaggtgaaaaggagagactttgagatctacaggtgtgagacggggtgaatggaggatgatacggaggtctgtggggcgagaggaaagtctgagtcgaaacagggatctgtaggaataagacgggtctatatgggcaatatagcgttttgtggagagagagaggggttagaggagggacaccgtggggagacccacgggggcgagattgggatgatatggaggccgttggaaggatgtgggattctagccgattggatagggaatgaagtgttgttgggcaggccattggcagtggtgtagtaggttcatgggtgagatgtgggctctggatgaacccacagcctttgggggttcagatgaagtaagagaccctgcaaatgccaaagccttgaggaacaagagaaggaggatgcagg

SEQ ID NO: 93405 - DNA, 2188 bp, Homo sapiens
  misc_feature (1933)..(1935): n is a, c, g, or t
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaagaaaaaaaaaaaaaaaaaaaaaaaaaaaaaaaaaaaaaaaaaaaaaaaaaaaaaaaaaaaaaaannnaagggggggcccgagaccaaaaacgccctatagtgagaaaaaatccttggggggggggccgggcccctattcccccttttgggggggaaattccccccccccccggcctcatttttcaaaacgcagaaccggaaaaacccggggggttccaaaattaaaagccctgaacaaaattcccttttcaacaattgggcaaatttgaaaagaagaccgcaaaatttacgcctttaacaatttggccaaaccccggatg

SEQ ID NO: 93406 - DNA, 1967 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagtaggagcagggcgcctttggggctggatgggagcgcggggaggcctgcgagcgctgagtaggggtcggagcagagctggggcagggctggagaagggcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaaga

SEQ ID NO: 93407 - DNA, 431 bp, Homo sapiens
  misc_feature (30)..(30): n is a, c, g, or t
  misc_feature (261)..(261): n is a, c, g, or t
tgagggtgaagcttgggaagttccagcttnctgttggatattcaggttggtttgggactggggagagaagttaattttgaccttttccctctcctctgcctggccccaggcttctgccaccatttctccacacaggagaagaccccccagatctgtgtggtgggcagtggcccagctggcttctacacggcccaacacctgctaaaggtaagccacttactcatagtccatcattcacctgctgctccagtcctaagggcnaagcctcacccgctttgggttttaagagcactcctggttgccttatggggaaggggctcccagccatctggcctggacacttcccacttgcttcctcacctacacctgaggctcccctcccctcccgtcctcagtgtgacaggggtgtaaaacgcacattggtggtgagt

SEQ ID NO: 93408 - DNA, 1870 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaaga

SEQ ID NO: 93409 - DNA, 1564 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaagaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaaga

SEQ ID NO: 93410 - DNA, 1950 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggaggtgagtctcatgtttcccaaagacacccccttcccaggcctctgccacccgcctggtgttgcccacactctccccaacagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaaga

SEQ ID NO: 93411 - DNA, 1698 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaaga

SEQ ID NO: 93412 - DNA, 1891 bp, Homo sapiens
gcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggaggtatacagccttggacatgctgaatccacgctgtgttcgcgtgttttgccgctcgcgtcggggctgcga

SEQ ID NO: 93413 - DNA, 488 bp, Homo sapiens
gactttaaatgtttaatttttggaaggttcaaggctgataggtgttaatagaaccatatctgccaatttcttattggcaaaggatttctcaagagtgtctcaaaattaaacactttggatatttacaaacattgctcattgagatgaggtaatgcagtcggctatttgggttctctcttcaaccttgccacaaacagactattttgctttgctctgatattttcccattgatactattcaggatcatagaattttataggtggctgagcatgatgtcttactccgagaaggtgcctgatgaatgcttatggaactgatttgaatagtttagtccttcattttacagctgaggagaatacagagaactgaagaggcttgtccaaggtcacacggctagatggtggcagatctgaaactagaagcagatttaccaactctcaattctctattctgtatctttactatgaaacatcatctgaccagggtgg

SEQ ID NO: 93414 - DNA, 605 bp, Homo sapiens
ggaggagggactctaagacctcccgtgggatggctgaccctggtatagtcacctgagctgagggtgggccctcgactctgcacaccgttagttcaatcctgccagagttgactggtctcagcgagactaactcagtagatccaactcataagaggttgatgtgtaacttgtattccaggctgttgatgtcccaggagaaacagaccttgcaagcagatcagattttcctgttatctaacctgtgccttcttctctagagggaactttggggaagcaaaatcatgataaggctcttgtttggtgagcaggactggagggaggaattgatggaagacttgggtgagtgctctggggccaaatctccctcccctggtccaggaggacagcatcccagcacctcttatcactttctgtctcctacagttaagccatgacctgacgatacatgcaacagtttgcctatcagacagctctgccagcctacaagttccagaaaggcaagcacagcatgttatccacatcttcagcagtaagtgctacatagaagatgctcagtcaacgtgcgtgtttgctttttttttaccatttgcagtcaccttcctaaa

SEQ ID NO: 93415 - DNA, 862 bp, Homo sapiens
cttgactctgggcaggtcctcaggtgcactgagaggagaacaaatagctcttataataaatggggcagttttctcaatatgattattatttttaagaaattgaaaatcattttgattatagatgtaacacaagcttggaaagaatttaaaacacacatacggttaaaaatggaatgccctgtattttcactttctaaagattgacacatggttgggcacagtggctcatgcctgtaatcccggcactttgggaggctgaggtgggcagatcacctgaggtcaggagttcgagaccagtctggccaacatggtgaaaccccatctctactaaaaatacaaaaattagccagtcatggtggcatgcacctgtaatcccagctacttgggaggctgtggcagaagaatcacttggacccaggaggcggaggttgcagtgagctgagatcacgccactgcgctccagcctgggtgacagagtaagactctgactcaaaaaaaaaagaaagacccatgtgtatccttctaagctgtgtatgtaaactgtatcattttaagaaccttgagatcattccatatatggtttggtaagtcacttgatgacacattatggaacatctttgagtgtcagtctgtgttgacctacctcattctttagtatagtagtgatgtggaagtattctattgtgtggaaggactgtaatttatttaaccactccttattcatggacacttagatagctttcagcttaacagtattacagtgctgttacaaacacttttgcctttaggtgcaagtatttctgtaggctcacttcctgtgacttgaatttccaagccaattgcttaccgaaatgtatgacag

SEQ ID NO: 93416 - DNA, 338 bp, Homo sapiens
gcatagaggatcttattctcatgcgtcagccacccaatgtagttctaattacaggcacgggctactacacctggctgatttttgtgtttttggtagagatggagtttcactatgttggccaggctggtctcaaactcctgacctcaggtgatccgcctgcctcagcctcccgaagtgttgggattacaggcgtgagccaccatgcccagccagtctggttttttttttattttttgagatggaatctcactctgttgccaggctggagtgcaatggcgcgatcttggctcactgcaatctccgcctcctggcttcaagcgattctcctgcctcagcct

SEQ ID NO: 93417 - DNA, 673 bp, Homo sapiens
ggttctgcaggctgtacaagcacgcaccagctctgctcggcttctggtgtggcctcaggaagcttctactcatggtggaaggtgaagggggagcaggcgtgtcacatggcaagagaaagagcgagagaggaggaggtgccaggctcctttaaccaaccagctcttctgtgaactcatagagtaagaactcaactcactactgcaagaacagcacccagccgttcatgagggatctacccccttgacccaaacatctcccaccaggcctccctccaacactggggatcacatttcaacatgacatttggaggggacaaacatccaaactacaccagctttaaactaacaaacttgatcaatggtactgctttgcctcccacctccccaccccctaaatcctgttgtggttctatgtaaaatttcaaaatttgtgtagacacaaacaaaatgcttcaaagtaagaaaggtacaagtaatttccactaaaaagaaacccccgaggctgggcgcggtggctcacgcctgtaatcccagcactttgggaggccgaggcgggcagatcatgaggtcaggagttcaagaccagcctgaccaacatggtgaaacctatctctactaaagatacgaaaaattagctgggcgtggtggcgtatgcctgtaatcccagctactc

SEQ ID NO: 93418 - DNA, 252 bp, Homo sapiens
ctttatgtgtttgtatatatgtacatatgtatgtatgtatgtatgtatgtatgtatgtatgtatgtatgagacaggggcttgctctgtcgcccagcctggagtacagtggcatgattacagctcactgcagccttaacctcccgggctatgggaggtatacgggaaggggtgtggagcttccgtgtcctgtgtggggcaccacccttccagctacctccccatgttcagcaacccagaagctcttgaaactc

SEQ ID NO: 93419 - DNA, 406 bp, Homo sapiens
tttctgtccataaatctttttcaaccacaagccagcacaaggtgacaccaaacctattctggctcaggacactgcctgattcgtgaatcattctttgctcaattaaactctactaaatttaatttttctaaagtttttcttttaacacctgcaatataatcataaatgtaactgtaaggggaaaataaattgttcttattttaaacaaaaaccgaattgcagttgcatttttttttaattacccatgtttacctttctgtttgttatttgtttgtctattcaactttcctcctgtaactcagatgtttcttctggaaccatttcccttcttcctaaaatatgtcctttggaacttcctttagtgagagactttggataataaaactctcatttttttgtgtgcttg

SEQ ID NO: 93420 - DNA, 321 bp, Homo sapiens
ttttgtatttttggtagagatggggtttcaccatcttggccaggctggtctcaaactcctagcctccagtgatctgcccgcttctgcctcccaaagtgctggaattacaggtatgagccactggaccaggcctctctgagccttttaataccttctgctttccagcatgtccacctcacttagtgtgggctttcacttttccctgcttctaggacccatcctagcagcctgtctgcaacacttctgggggtcttttccaggtattaaatgctatattctgctctgagttgataaactctaactttcccttatccactatcc

SEQ ID NO: 93421 - DNA, 369 bp, Homo sapiens
cagtttaataaaacagtagatcagtctcactaatataaattcaaaagtaaaaataaaatattagcaaattgaatctgccattgtatcaaaagaattctagactatcaacactagagtttatttcagacatgtaatgatgatttgttaccaggaaatctgtcaacataatttattctatcaaagggacaaataatcatagaagctattctcatgagaatttgaagtaaaatgggtataagaaggcagttatgcctgtaatcccagcactttgggagggcgaggcagttggattgcttgagcctggtaggtggagtttgcaatgagccaagactgtgtcactgtacttgagcctgggcaacagaatgagac

SEQ ID NO: 93422 - DNA, 702 bp, Homo sapiens
aagtagcactatggagattcacacgtggcaaagagctgaggcctcccaccaacagccacatgagggagccagagtaggagtggctcctccagccccagtcgaaccttcagatgtgacagacttggctgctgacagtttgcaatctcatgagaccctgagccagaaccacccagctaaatcagtcctggactcctgatcaacagaaatgaccaaagagaggcgttttgaacattaagacgctttgctgcttctcacctgaaacacgtaacaggaacaccaacctcttcagccgcgggaaatcttctttgacacaaaactcaaaccgagtcaacccaaagttccaagttctttgctttctcttctgtgtgtgtgttggtttgtcccaaaagtcagtttgcaagttgaaacttcatgaaattactcgtagcagaaataaagtacattgtacaaatcacgcaggtctgcgatgtggagtataaaaatggtatttacagccagtaaacatggaccagaaagacacgtacaactgcacaccggcacacactcccaagcaggccctcgggggcctcggcgggcgccgcggacacgggtgaggccccctcgaggcagattggcatggcacacgcttgcacacggggacacacggaacacaggcacgctagaggagagtctcgaaacaattatcaaactctggaatatcga

SEQ ID NO: 93423 - DNA, 608 bp, Homo sapiens
agcctaggcctgcagagactgctcagtcacagttgaaggagacctactgagtcctgaggacaaccaacaaaggccttaacggcacagaaggaagtcctgtcttctgggattgagtttggtaatccaccccttggagctaaacacagtagtatccttagtcgttgggatggtgggagagggagaagaggaaggatgaaggaaagggctctttgctagtatctccatatctagaagatggtttaaactcatacccatagctctatatgagcattttcagtaaagtgcctgtgtttgttgtggacaagttttattattttgcaacatctgagctttatgaaagtcctggagtgacaatgtatgataaaaagtagagctagtgaattaggcaatttattaatattttttgttataactgatagaaaagatgcatcttgaacatggaattgttaagccacgtctgagcagtgtatgtcaggacttgttcattaggttggcagcagaagggcagaatgaagtataaagggagagatgtatgcaaatgtgtctatgtttacattttgatactagtcattgatatatgtgcaactcttttggctgtactataggaa

SEQ ID NO: 93424 - DNA, 389 bp, Homo sapiens
  misc_feature (18)..(18): n is a, c, g, or t
  misc_feature (24)..(24): n is a, c, g, or t
  misc_feature (52)..(52): n is a, c, g, or t
  misc_feature (69)..(69): n is a, c, g, or t
  misc_feature (136)..(136): n is a, c, g, or t
gagacaaagatgagaaanaaagantcacacacggggggggtgtattatgttnagatatttttttttaancctcaggagatgtttttttttgtaggaaatttataaaaacgcccccccgctcacaaaaaggagggtntttcgctgcctcccgggggggccaccccctataggggggggggggaggggggttcttaaacaaccccgagcggcaaagagggtttccccccacaaataatataaacccaccaaggcgccagaaggtgtgaatagtttgatttaattattccacattatatgcataaatagtaacatcaccttgttccccataaaattatacaattataaattgtcaatttgcaattaaaacaataaaatccagccagacgttg

SEQ ID NO: 93425 - DNA, 638 bp, Homo sapiens
  misc_feature (626)..(626): n is a, c, g, or t
  misc_feature (638)..(638): n is a, c, g, or t
agcctaggcctgcagagactgctcagtcacagttgaaggagacctactgagtcctgaggacaaccaacaaaggccttaacggcacagaaggaagtcctgtcttctgggattgagtttggtaatccaccccttggagctaaacacagtaagaggagcccacccttttcttactatacagagaagagtaaaacacagtcacctttacacagcatctgagtggacctaacacagggcagtgaaagtgatgcagaacaaacttcaaagcctccaggagcacacgtgacctcaggaaatgaacagaaacaacctagctctccaaagaggagtatttcattcaactccgaactgctcacacattatgcaactgtgaacaaggctcatttaaaaatccatgaagcttctaatgttttcaccacaaaatatattaagtattgaggtgctggatatgttgactagtttgatttaattattccacattatatgcataaatagtaacatcaccttgttccccataaaattatacaattataaattgtcaatttgcaattaaaaattgtgacatacagatgcgtccagattttccctttatttttcaaattcttcttcttcctcttccctttccctcncccccccccctn

SEQ ID NO: 93426 - DNA, 753 bp, Homo sapiens
  misc_feature (741)..(741): n is a, c, g, or t
  misc_feature (753)..(753): n is a, c, g, or t
ctcactcagctcacccattaaaccctgcgggtctgtttcactttttccttcccacacaaacattacagtaacagtctggccttcccaaaccaccactggaaacttcaactgaactgatcatatatcagtcaactctaggagaccagctctgattccaagaaactgtgacattgcctccattggaagttacaaccttcacctgccaacctggactcatcccataggttgtgacatcagaaagttgatagacgtgatcgctaagaatcttgccgaatattctaggactacaagtaaaagagaccctattttctgtgctgggaaaagcatctgagtggacctaacacagggcagtgaaagtgatgcagaacaaacttcaaagcctccaggagcacacgtgacctcaggaaatgaacagaaacaacctagctctccaaagaggagtatttcattcaactccgaactgctcacacattatgcaactgtgaacaaggctcatttaaaaatccatgaagcttctaatgttttcaccacaaaatatattaagtattgaggtgctggatatgttgactagtttgatttaattattccacattatatgcataaatagtaacatcaccttgttccccataaaattatacaattataaattgtcaatttgcaattaaaaattgtgacatacagatgcgtccagattttccctttatttttcaaattcttcttcttcctcttccctttccctcncccccccccctn

SEQ ID NO: 93427 - DNA, 815 bp, Homo sapiens
  misc_feature (803)..(803): n is a, c, g, or t
  misc_feature (815)..(815): n is a, c, g, or t
agcctaggcctgcagagactgctcagtcacagttgaaggagacctactgagtcctgaggacaaccaacaaaggccttaacggcacagaaggttgtgacatcagaaagttgatagacgtgatcgctaagaatcttgccgaatattctaggactacaagtaaaagagaccctattttctgtgctgggaaaagaagtcccaccagtgtgatcaggaataaaacacttcaggtgcaacgtgatcattattcaaaggttctgtgaagccaattaccccctttgcaaagtgaaaagtgcaactttggatttttctgatcagagtaatatagagaggagcccacccttttcttactatacagagaagagtaaaacacagtcacctttacacagcatctgagtggacctaacacagggcagtgaaagtgatgcagaacaaacttcaaagcctccaggagcacacgtgacctcaggaaatgaacagaaacaacctagctctccaaagaggagtatttcattcaactccgaactgctcacacattatgcaactgtgaacaaggctcatttaaaaatccatgaagcttctaatgttttcaccacaaaatatattaagtattgaggtgctggatatgttgactagtttgatttaattattccacattatatgcataaatagtaacatcaccttgttccccataaaattatacaattataaattgtcaatttgcaattaaaaattgtgacatacagatgcgtccagattttccctttatttttcaaattcttcttcttcctcttccctttccctcncccccccccctn

SEQ ID NO: 93428 - DNA, 481 bp, Homo sapiens
atttggactctgacttaggacctgtcattaaatctttctgtgatcttgggcaggttgtgacatcagaaagttgatagacgtgatcgctaagaatcttgccgaatattctaggactacaagtaaaagagaccctattttctgtgctgggaaaaggcaagtcaagcccaactcttcttttctggagctctattatcctccttccaccccaccccaataacccagagaagtaactggccccatcattcagaaggcaatggataaagttgggttgaatcagtaggtctatttttttttccagttattttcactctcccaagcttaagtggaatttctcatcaagttctaaccccagaaacatcattatgagtagcacactttaagccagacattgacaaaccagactttgtccagagaagactagccagaatggcaagggtttgagaattttgtctaatgaaaaataagttagaaaataagatgt

SEQ ID NO: 93429 - DNA, 495 bp, Homo sapiens
ttgccaaataacttccagaagaagtgagcttttaccaagtaaaaggtgaaagctaaaatcctgctcactactggcagcacttagtctatcgccctgttacatacattaatacatcacacccatggaaagtctgtattttatccccatttcacagttgagaaagctgagcctcagacgtccatgcatgacttctttgtatgcttttcagcaaaggtcagtgggaaattaaattatagaatatgccatgcactgtgcagatattttaatccgtttttcttacaaccctatggggaagttatcatctccatataagactagagagaactgaggttcaaggttaaggacggccaagcagtgaggtgtcagaggtgagatttgagctccattcattcatctccaaaccaaagtctttgttccttccaccaatccagccacctccctctggcagagaagtcagtaccaatgagtgggacgtgctgagatggagccaatgtt

SEQ ID NO: 93430 - DNA, 431 bp, Homo sapiens
ttttttttagctttttgtttgttttgtttttagagacaggatctcactctgtcacccagtctggagtgcagtggcacaatcatggctcactgcatcctccaactctcaggctcaagtgatcttcctgcctcaccctcccgtgtagccccagctatgttttgcatatgggactgcaggcatgtattaccaggctcagctaatttttaaacatttttttgtaaagatggggtcttgctctatcgccaaggctgatctcaaattcctgggcttaagccatcctcctgtgtcggcctccttaagtgccgggatgacaggcatgagctactgtgcctggctgatacattttgccaagctctaaatgaagttagctttaagaaatttctttgaaaaaaattctctgaaatcttaaaaacaactttttgaaatggaac

SEQ ID NO: 93431 - DNA, 403 bp, Homo sapiens
ctgaattgtatggaaagatggagcaagcttgaactaccctagcaatgccaactactttcattgctcctgcatcttagataaggaacataaccaagttttccatccttggccccctagggtctctacatgtccatatctgacaagaatctgtgaagaccaagctcaaagccagcacctcctaaaaagctgcctggcagctctgaatagtggttttccttctgcctcccacagcacagatcacatcccttcttgttttgtgcatacacagctcattgtacagtggtcctgcctcttgttgatggtgagctccctgaggccaggcccctgagctaattcccagtgcactgcagttcttattttggccagtggttccacctgctaaacagcctccaggtagcttatt

SEQ ID NO: 93432 - DNA, 868 bp, Homo sapiens
cttgctctgattttgcagagcttttgaagacattttccccttgtttgggaatcaatatgaaaacattgattgtcctgcaattatcaatgttacattgtctctggagtttttggccttgtttcaatgcaataaatcaagttgtagattgctggtggccttagcagagcaattatcactgcagcacataatatccagcttgctgccttattgtgattcagagacctagtcacaagcttgctttttgtctaagagccaacaactaaaaacccaagtttccatcaacagaaggaataaattgtggtatattcatacatggagtactatgcagccacataggagctaactactgctacatataatacggagtaatctcagacatgatgttgaacaaaagcagacaagcacaagtcaatatgtgtgcatttatttatatgaaattcaaaacagctactacaaatataggacataggaagaatgtctacctttggggaagggggcaaatattaactgagtagggacccaagggagccctctgaggtactggaaatgctctatatttttatatgagtggttacagggtataatcattggtcagggccaggctcatgcctgtaatcctagcactttgggaggccgaggcgggtggatcacctgaggtcaggagttttgagaccagcctgaccaacatggcaaaacccggtctctactaaaaacacaaaaaattagctgggtgtggtggtgggcgcctgtaatcccagctactcaggaggctgaggcaggagaatcgcttgaacccgggaggtggaggttgtagtgagccgagatcccgtcactgtacaccagcctggcgacaagagcgaaactccat

SEQ ID NO: 93433 - DNA, 485 bp, Homo sapiens
gaacaaagcatatttactggaatgcaaagatatctactgttttaccaaatgtcaaatatccaatcagagattatgagacatacaaagaagcaggaaatattattaatactgacataatgaggaaatgattaagcaatcaaaagtgacccatgattaacacagatgttacaattagcaaagaagtacattaaaatagttatcgctgggcgtggtggttcacgcctgtaatcccagcactttgggagaccgaggcaggcagatcacttgaagtcaggagtttgagaccggcctggccaacatggtgaaaccctgtctctactaaaaaaatacaaaaataaaccgggcgtggtggtgtgcacctgtaatcccagctactctggaggctgaggcaggataattgcttgagccctggaggtggaggttgcagtgagcggagatcatgccactgtactcccgcctgggtgacacagcaagactctgtctca

SEQ ID NO: 93434 - DNA, 2300 bp, Homo sapiens
agagcctgtgctactggaaggtggcgtgccctcctctggctggtaccatgcagctcccactggccctgtgtctcgtctgcctgctggtacacacagccttccgtgtagtggagggccaggggtggcaggcgttcaagaatgatgccacggaaatcatccccgagctcggagagtaccccgagcctccaccggagctggagaacaacaagaccatgaaccgggcggagaacggagggcggcctccccaccacccctttgagaccaaagacgtgtccgagtacagctgccgcgagctgcacttcacccgctacgtgaccgatgggccgtgccgcagcgccaagccggtcaccgagctggtgtgctccggccagtgcggcccggcgcgcctgctgcccaacgccatcggccgcggcaagtggtggcgacctagtgggcccgacttccgctgcatccccgaccgctaccgcgcgcagcgcgtgcagctgctgtgtcccggtggtgaggcgccgcgcgcgcgcaaggtgcgcctggtggcctcgtgcaagtgcaagcgcctcacccgcttccacaaccagtcggagctcaaggacttcgggaccgaggccgctcggccgcagaagggccggaagccgcggccccgcgcccggagcgccaaagccaaccaggccgagctggagaacgcctactagagcccgcccgcgcccctccccaccggcgggcgccccggccctgaacccgcgccccacatttctgtcctctgcgcgtggtttgattgtttatatttcattgtaaatgcctgcaacccagggcagggggctgagaccttccaggccctgaggaatcccgggcgccggcaaggcccccctcagcccgccagctgaggggtcccacggggcaggggagggaattgagagtcacagacactgagccacgcagccccgcctctggggccgcctacctttgctggtcccacttcagaggaggcagaaatggaagcattttcaccgccctggggttttaagggagcggtgtgggagtgggaaagtccagggactggttaagaaagttggataagattcccccttgcacctcgctgcccatcagaaagcctgaggcgtgcccagagcacaagactgggggcaactgtagatgtggtttctagtcctggctctgccactaacttgctgtgtaaccttgaactacacaattctccttcgggacctcaatttccactttgtaaaatgagggtggaggtgggaataggatctcgaggagactattggcatatgattccaaggactccagtgccttttgaatgggcagaggtgagagagagagagagaaagagagagaatgaatgcagttgcattgattcagtgccaaggtcacttccagaattcagagttgtgatgctctcttctgacagccaaagatgaaaaacaaacagaaaaaaaaaagtaaagagtctatttatggctgacatatttacggctgacaaactcctggaagaagctatgctgcttcccagcctggcttccccggatgtttggctacctccacccctccatctcaaagaaataacatcatccattggggtagaaaaggagagggtccgagggtggtgggagggatagaaatcacatccgccccaacttcccaaagagcagcatccctcccccgacccatagccatgttttaaagtcaccttccgaagagaagtgaaaggttcaaggacactggccttgcaggcccgagggagcagccatcacaaactcacagaccagcacatcccttttgagacaccgccttctgcccaccactcacggacacatttctgcctagaaaacagcttcttactgctcttacatgtgatggcatatcttacactaaaagaatattattgggggaaaaactacaagtgctgtacatatgctgagaaactgcagagcataatactgccacccaaaaatctttttgaaaatcatttccagacaacctcttactttctgtgtagtttttaattgttaaaaaaaaaaagttttaaacagaagcacatgacatatgaaagcctgcaggactggtcgtttttttggcaattcttccacgtgggacttgtccacaagaatgaaagtagtggtttttaaagagttaagttacatatttattttctcacttaagttatttatgcaaaagtttttcttgtagagaatgacaatgttaatattgctttatgaattaacagtctgttcttccagagtccagagacattgttaataaagacaatgaatcatgaccgaaag

SEQ ID NO: 93435 - DNA, 560 bp, Homo sapiens
tggtagatgctcagtaaatatgtgctgaatgaatgaatgaatgaatgctaccttggttctttctgggtctgaaatacaaagatcttattccagatggctgatgaagtgtgataggaagggcagaaattagccgaagaagaggctggtaaactgtccagccccacctatggcctaaagggctttcgcgccaccccctcccacccgacagtgatctgtggttgggggcaggtggaaagcagggagttgcataaggcacataatctgagagttctaagaaggacccgtgagagcttggggctagaagctgcatggcttcctgcacttccagttgggaggatttggtcgcatggataatatttagaaaagtgaaagaaaactggcacattggttcagggctcagcctgtgacctaagtcaaggcttgatctgagatcaggggcaggaccaggctcagggcttggagtgaccaagatcatgacttctgcagggccaggactggggctccccctgtgaccagaatcagagctcagtccgtgacagagattagggctcagtcaggag

SEQ ID NO: 93436 - DNA, 366 bp, Homo sapiens
ttcctcattcccagtaggttccaagtccctcttgtggtgcacacttcctgccatgctggacagagcctaatgtttcagatgcggtaggattgggggtcagctactgcatagctcctaattatggggactattgtgttatcctgaggcattagaactggacatagcctaatgtttgaagatgcggtaggattgggggcagccgaggcaggaggatcacttgaggtcaggagtttgagaccagcctggctaatatggtgaaaccccatctctactaaaaatacaaaaatcagctgggtgtggtggtgcatgcctgtagtcccggctgctcgggaggctgaggcaggagaatcacttgaacccgggagg

SEQ ID NO: 93437 - DNA, 477 bp, Homo sapiens
caggctggtttcaaactcctgacctcaggcaatccacctgcctcggcctctcaaagtgctgggattacaggcgtgacacgccagcacgcctggctcagctttacttttcaagcccatcactaacatcacgtggatttggccaagttactgttgaggaaatctatgggattattccctagtcctaggcaatagtcctaggcactggccccagcctgactttgcacaaatgactatggtggaggctgaacctgattttacacaaaccagcaaccccacacaccacacctggcccagccaagttggctgatctggggatgaacatgtagtcttagttggaacattaagactcctttctagaattttgcatttgggtctagaaagggaatctgagtgttggatataacactgggccaccatcagtggttatgttgctgccacaggaagaaagccagattccaggacaggggactgaaggtg

SEQ ID NO: 93438 - DNA, 419 bp, Homo sapiens
aaaaaaaaaaagaatgctctgaatagtcttgagctgccagttaagtgtttggagtgcaagtgatttgcttcattttgcatacaactcactggctagaaccaatcacatggccccactcactcacaaatcagtaagccaggaagtgtccacagcagcagagagctggaaacatttggtgatctgctgtggtgtgtactatggcaggaagtcttctccacttgaagatgggggacctgaggctaagagagtttaaataacgatcaagaacattcagcttgcaggtgactgggctcaaactcaggcctatctgggtctaggacccaggtgtttaactgctaagctataggtttttcatctcttaattaattgtaaaatcagtttcttcccttcagtgaaaactctcagcttagaaagaaaat

SEQ ID NO: 93439 - DNA, 246 bp, Homo sapiens
gagatggagttttgccatgttgcccaggttggtctcaaactcctgaactcaagcagtgtgcccacctcggcctcccagagtgctggaattacaggcgtgagccaccgcgcccggcacaatatgcaattcgttttgtccagcctctccctctgatgtcttcattcttcccattacaactccgcatgtctcctgtggtggaaggcatcagtggccccaatttttcacccttccctttcacatgttttg

SEQ ID NO: 93440 - DNA, 159 bp, Homo sapiens
ctccatgcccagctctattcacagtggctgatcaggtctttactgcggatctggaaagaagctgatagaagatgggtgccagaggggcctgggtagagatgttagctgagagatacccagtatggattctgtcagttttctgggtgagcatacacattc

SEQ ID NO: 93441 - DNA, 409 bp, Homo sapiens
aggttttgcaagtcaagtggcaaaatcaaggatgatgttatgaagatatttatataactatttaaaatgtgaccattttaaactggataggccagtgggctcactcctgtaatcccagcacttcgggagcccaagatggttagatcgcttaagcccaggagttcaagaccagcctgggctcaagcagtccgctcaccttggcctcccaaaggtcgaacagcatagtgaaaccccgtctctaaaaaaattagataggtgtgctggccaatttgcctgtaatccgagctattgcctgtaatccgagctattcacgaggctaagatgggagaatcacctgagcccaggaagttgaggctgcagtgagcagtgattatgtcactgcactccattctgggtgacagagtgagac

SEQ ID NO: 93442 - DNA, 596 bp, Homo sapiens
ttacaacctggattagcagaggaaggaaagaaaaaataattctggataagaacagtttttgtgggctggtccaaaggcagtgagttatctcaactgactgttcacagtcagttacagatcaaattctttgttctattctttccccacttctcactactgtgcttaactagtcttagaggggaaaaacagtctatgtaaagagggattggaacagtatggtatcttccatttaggtatatgtaagtaagtcaggattctggaacttgaagtattaatataaggaaaggagtaatgggagatgaggttgaagggggaggcctccattataaaggatgctatatgcctgctaagcaatctggaccttaacttgtaagcagtgggtgaatccatgaactacagagtactaagtaggggaagagataagatcagattcacttttaaatcactgtgcaagccatgggaaggttgaactagagggaggtaaaggtaggtacgaggctatttgtaactatccaagtgagaggtaataaggcaataaagagtaggaatgaagccaaaaagaaaacctaaagacacttagaagatagaaaaggtgg

SEQ ID NO: 93443 - DNA, 1729 bp, Homo sapiens
  misc_feature (15)..(15): n is a, c, g, or t
ggaatatctttagtncctactagaagaaaggtcttgttttggaatttacattctctgcatacgatgttctgatgggacagcaagaacttacacatcaactagtttatactacatgtcctttgtctaactatctatctatatagacatatgtgctagtttagaaaattgtcaaatcagcatgtcagtaccaatggaaaaattgtctttgatatgttatatttttctcacttaggaaatgtgcttaatttccaagggtttttttttttaatgttactattgaagcatgaaaagttaacatcatttgttatcctttctttccccactatatattgtcttacccagagtagggctatactttggtggtgttttaacatcttctaataagtgatcataagcaacatacagatgctaatatttgaaatcttgttttttcttacttcctaataatcaaattatattaatatttcacactacaaaaaataggattttctaatttgtaaaaacaagagctcctgctatctcttggaagttaagtccttaggaaccctatcttatctttctaaaaataataagtaagaacaatcacatgtgattctggctattaaaatcatacatccctagtggaattaacaagcttgaccaattatgattatgctaaattgttttaggctaggaggactgtcagtccctacttcttcccatttttcttgggatatctttatattggctagatttgttgccaatataaaattgacacagcagagacactcctctaacttaaatttttagtggagtttggtttttgctaaccccgtactaataaacactttaatgacttttttcatttcaaaatatttaaatgtataaaattgcctatgctgcttattgaaagaaccgtccttttgggcataagaagactttttcaacctaaaccgttatgtgtgatttattaacaacttaacaaagaaagtaccaacatctctcaaaatgtagttgatattcttacctatctcagaaatattaacgaattggattcacaaaagaatgtcttacatactgttgacatttatgtgaatattctttatactgttgtaaatgtttcattcaacttaataacattttaaaagatgtatgtatctgatttttctttagaaaatattatatttttatttgtattttttacattttaaagttcatctctatgtgcagctatttttatattgccaaaaactcacataaatacaaaataagtgaaatatgcaaaaaaaaatattttggcaagcattacactgcatatttttttaaatgtttgtgggccagtctcatacaattgattattctaagaatgtgttgtgtcttatcactgtaaatatggcacaaacctgtttatctcagtagtgtaaataattgaaagattgaattctccctgttcaatttttattttaatttccttgtaatttctccagctgacattactgtatcaaaagatgcataagatttttgatttgcggtttggagataattgcattgtgttcagtttccagtttgtttttatttgctttttaaatttgttttcagggttcctagtttgtgagaagttgatcttcagaattatttttacactatttatgacttattttcataatgtaaaaagtgtgtaattattacaatattaatccaaacaatgataatgaattgtattgttataaagctttattgatgttcatga

SEQ ID NO: 93444 - DNA, 618 bp, Homo sapiens
taattgttctagcccactttttttttctggtctataaagcattgaacccccctgtacacgactcactccttttaaagaaaaaaattgaagtataaagctttgagctcaacgctttatacttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagt

SEQ ID NO: 93445 - DNA, 586 bp, Homo sapiens
gacttctttattcctgctttcagttttcctcacatagcagctttgtatgtgtattgccagctatattttgttctttagaaatatcttggattttccaagatatatatacatacacatacataagtgtgatgaaggttcaggtagcttactagctttctattgctagtaccctaaagactagtactctaataaggagactaaggtggcacccacatagatatcttgcatcctcagttgtgtgtgtgtgtgtgttcatatacatatgcttatttcttctatcaagggaaaagttcagttagaagacatacttcaccatcttgaaaaagaagaaatcaatccccttgctactacagaagaacaactctgtttggtgcttattccagccagcacagtgaagacaggctgaggactgctaccacagatgtagaagagcttatagtgaagcacatgggtgaaacaaaagaagtgagaactaatagcatagaattttaaagacacctgtgattttgttcattgcccttcattaaattgacatattaaaaactaatgtttggctatcactgtatagtttgaaaagcacccacgt

SEQ ID NO: 93446 - DNA, 671 bp, Homo sapiens
tgacgcccaggtctccgtcggcacctgcagctagcagctgagcgcgtaggggccgagcgaccccgggacgctcgcggcaccctccgcaggaaaatttccgacttggttcttgaggttcctgcctcagccccaaggaggaaagcacccattctcccctcttttccgcattccgggccttttctgcttctccccagtatggtccgaaactacaggaggggaacccctcctggcccggcctttctattccctggctggagtgattccgcctgaaggagaattcgcccgttttccccggacccagctgccacaagcatttagtattaggctgccgcttattattagagcgggcttagaacatcctcagcgagggaaaagttcagttagaagacatacttcaccatcttgaaaaagaagaaatcaatccccttgctactacagaagaacaactctgtttggtgcttattccagccagcacagtgaagacaggctgaggactgctaccacagatgtagaagagcttatagtgaagcacatgggtgaaacaaaagaagtgagaactaatagcatagaattttaaagacacctgtgattttgttcattgcccttcattaaattgacatattaaaaactaatgtttggctatcactgtatagtttgaaaagcacccacgt

SEQ ID NO: 93447 - DNA, 513 bp, Homo sapiens
cacgctgcacattattgaatgtccatttgtctgcaccacctctgtcatctatagaccacctccttctgctttcctgctacaatgctttgcgtacctaagtatttcgcattctcccagctctgcagtcattgggaagattttctgtttttctttgcactatggcaacctttcagtcttgggtaaactagagactaggagaagtgcaaattgggaaaagttcagttagaagacatacttcaccatcttgaaaaagaagaaatcaatccccttgctactacagaagaacaactctgtttggtgcttattccagccagcacagtgaagacaggctgaggactgctaccacagatgtagaagagcttatagtgaagcacatgggtgaaacaaaagaagtgagaactaatagcatagaattttaaagacacctgtgattttgttcattgcccttcattaaattgacatattaaaaactaatgtttggctatcactgtatagtttgaaaagcacccacgt

SEQ ID NO: 93448 - DNA, 401 bp, Homo sapiens
cccattccatgtacaactgactgaatggggaaaatacagattgatctggagcatagcagagagagattcttatttaatctttcaaacaacagagtgagggaaaagttcagttagaagacatacttcaccatcttgaaaaagaagaaatcaatccccttgctactacagaagaacaactctgtttggtgcttattccagccagcacagtgaagacaggctgaggactgctaccacagatgtagaagagcttatagtgaagcacatgggtgaaacaaaagaagtgagaactaatagcatagaattttaaagacacctgtgattttgttcattgcccttcattaaattgacatattaaaaactaatgtttggctatcactgtatagtttgaaaagcacccacgt

SEQ ID NO: 93449 - DNA, 171 bp, Homo sapiens
gcggcgcctactactactactactactgctcgattcaagcttctaacgatgtacggggccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93450 - DNA, 1516 bp, Homo sapiens
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93451 - DNA, 1530 bp, Homo sapiens
  misc_feature (1483)..(1483): n is a, c, g, or t
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtatcnggccgactcctctcttcgccatccccgctacttatcttctccctcca

SEQ ID NO: 93452 - DNA, 1043 bp, Homo sapiens
gtttagaggctgcagcttgagctacaatcaggaggaaacccctcctctggagggcagatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93453 - DNA, 1071 bp, Homo sapiens
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93454 - DNA, 1689 bp, Homo sapiens
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggtgcgtgccctaggagtaccccttttgcctggaagcacagcctttctttccagccacttatccccttacctcctgcttacccacggatctcagctggggaacccgagttgagaaggagctgatcctatatcgtacctcgccgatttgttaacaccttgtgtttctctttgcaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93455 - DNA, 2734 bp, Homo sapiens
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagtatcataatgaagacctggaaaaagacaaaacatcacaaaactgcctaggaagaggaatggaacaagtagcaaagaagttaggggtggctcatgaagagattcaaaggctcactgatgagctacaagtgaaggagaaggaacaatgtaaattagattctgcacttaagaaggctcaactagaaattgacaaattgaaggaaaatttggtaaagctgaaagaaaatgatgcagctgacctacagaaagcaaaggaacaaaatcagagactggatgaggaaattctggctttaagaaatagggttcgatcacttgactcagaaaaaaaggtgcttggtgaaatggttgaaagacttaaaggagaggtgtgtgaatctcaagagaataagcaacttggaaaccactcccctggaaaaactgtgggtggtgaacagagagaacagattgaggcttccatgttagagcctgaattatcagtaacataggaagatagaagagaaaccagtacaaaagatcaagagacaaagtacaagatttgaatgagatcctgaaaatgagccaagaaaaaaatgaaatgtttgaaagtgagtggtcaaaagagagagagagagagaagcagttggcatctggtcttgacactgcagagaaggccttgaaagttgaaagtgaggtattaccattcaggaagctgttttcttcttcttgtagttctaatttagggatttcatgttatcatttttaaataaagtataactatgtgtctcagcttgggctgccataaccaaacaccacagactaggtgtctcaaagaacagaattttattttctcacagttatggaggaggggaagtccaagatcaaggtgccagccaagtcagttcctggtgagggttctcttcctggcttgcagatggccaccttcttgctgtgtcctcacatgacagagtgagcaagctctggtgtctcttcctcttcctataaaggcactaaccctattggattaaggccccacccttatatcctcatttgacctttatcacctccttatcaaccctatctatctccaaatacagtccatattgggaattagggtttcaacaatatgaatagggagggagagcacaattcagtccatagcactgtagaatacgtgtttctataataataatggggtagctctgttgtttctccaagctgagttctagcactaagcaaagagtcctttatttagcagacgtttgattgttgtagtgttcatagagtcatgggcttatcgctcgttttaacttcttgtcctgccatcttggaaagatctatcaggagacataatcagcctatattatgaaaagagacctggaagtgagttcatggaagtctaaatcagtaatttagaggatagtgacactcaatcagtttgtagtttgcagtgcccctaatctcatcctaatgacctacaggaattttcagtgaaataagataggaaatcaattatcatttaccctcttcctgtggttttgggaggccaccctctaccttcttgcctttttgtctaagcctttctaatcagcatttacctcccactttgacttcaaggctttgggaaaataccaagtagctcctctcctgaagtaaattttatgtaacctattcccttcattgagcaccacagactgactctcaacccaaagtcttccaccagccaatcagtgcacatcctgtgtcatcaatgtaaaaatctgttaaaaatctgcatttaggttgggcacggtggctcacgcttgtaatcccagcactttgggaggccaaggtgggcggatcacctgaggtcaggagttcgagaccagcctgaccaacatggagaaaccccatctctcccgaaaatacaaaattagccaggcgtggtggtgcatgcctataatcccaggtacttgggaggctgaggcaggagaatcacttgaacccaggaggcagagattgcagtgagctgagatcatgccattgcactccagcctgggcaacaagagaagaaactccatctc

SEQ ID NO: 93456 - DNA, 1093 bp, Homo sapiens
cctagctgcagcggctctcttaaactttattttattgacaggtttaggataggctaaaaactgattttccactgctgatgaagaatatgtatggagccttgaatttaggcatcgctgtgaactctacagagccaaggctttttttttgtgagacaaggtgtcgctctgttgcccaggctgaagtgcagtggcatgaacacagctcactgcagcctcaaccttccaggctcaagtgatcttcccatctcagcctcctgagtagctgggactacagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93457 - DNA, 677 bp, Homo sapiens
tagaggtaccccggtcgcacttctgaatctcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93458 - DNA, 1000 bp, Homo sapiens
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagggaaaagttcagttagaagacatacttcaccatcttgaaaaagaagaaatcaatccccttgctactacagaagaacaactctgtttggtgcttattccagccagcacagtgaagacaggctgaggactgctaccacagatgtagaagagcttatagtgaagcacatgggtgaaacaaaagaagtgagaactaatagcatagaattttaaagacacctgtgattttgttcattgcccttcattaaattgacatattaaaaactaatgtttggctatcactgtatagtttgaaaagcacccacgt

SEQ ID NO: 93459 - DNA, 1006 bp, Homo sapiens
gtttagaggctgcagcttgagctacaatcaggaggaaacccctcctctggagggcagatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagt

SEQ ID NO: 93460 - DNA, 1479 bp, Homo sapiens
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagt

SEQ ID NO: 93461 - DNA, 1536 bp, Homo sapiens
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtaagagatgcggccaaccctcttctttcccttcacactacctcactccagttgactct

SEQ ID NO: 93462 - DNA, 1733 bp, Homo sapiens
aagcactggatcaacgcagagtgcccattacgggcgtggggcggcggccgcgaaacgtgcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcaggtgatgggcgcttctcttccagagatctaatcccatataaccaatcttgggttaatttcctcttgatctggagatggcctttctgcatctgtattcgctaggcacaggggatacagagatgaataagacaccgccctccctcatggacctcacaatctagtgagggagctggacacagacataattacaatacagagtgataaatgctctagtggagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93463 - DNA, 1083 bp, Homo sapiens
tggcccgagtttaggcatctgatagttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93464 - DNA, 2751 bp, Homo sapiens
tgacgcccaggtctccgtcggcacctgcagctagcagctgagcgcgtaggggccgagcgaccccgggacgctcgcggcaccctccgcaggaaaatttccgacttggttcttgaggttcctgcctcagccccaaggaggaaagcacccattctcccctcttttccgcattccgggccttttctgcttctccccagtatggtccgaaactacaggaggggaacccctcctggcccggcctttctattccctggctggagtgattccgcctgaaggagaattcgcccgttttccccggacccagctgccacaagcatttagtattaggctgccgcttattattagagcgggcttagaacatcctcagcgaggtaggtcggcgttccttttctcacttaaaggtgaggtgtcgagacgcgcccctggacagacaacgcccgaaggtccaggccactacgaagtccacggaggggcagctttcccctacgtgtaggcccgcgaacaaagaactaccgttttctgattttttttggccgatgttcgtcatgcagaaccttgaatcccgatgaagatttggaggcctttgtatcctcaacatcagaggtcatgaagttggagtgctggagtgcagtagcatgatctccgttcactgcagcctcaacctcctgggctcaagtaatcctcctgtcttgtcctcccaaaatgctggaattacagtatcataatgaagacctggaaaaagacaaaacatcacaaaactgcctaggaagaggaatggaacaagtagcaaagaagttaggggtggctcatgaagagattcaaaggctcactgatgagctacaagtgaaggagaaggaacaatgtaaattagattctgcacttaagaaggctcaactagaaattgacaaattgaaggaaaatttggtaaagctgaaagaaaatgatgcagctgacctacagaaagcaaaggaacaaaatcagagactggatgaggaaattctggctttaagaaatagggttcgatcacttgactcagaaaaaaaggtgcttggtgaaatggttgaaagacttaaaggagaggtgtgtgaatctcaagagaataagcaacttggaaaccactcccctggaaaaactgtgggtggtgaacagagagaacagattgaggcttccatgttagagcctgaattatcagtaacataggaagatagaagagaaaccagtacaaaagatcaagagacaaagtacaagatttgaatgagatcctgaaaatgagccaagaaaaaaatgaaatgtttgaaagtgagtggtcaaaagagagagagagagagaagcagttggcatctggtcttgacactgcagagaaggccttgaaagttgaaagtgaggtattaccattcaggaagctgttttcttcttcttgtagttctaatttagggatttcatgttatcatttttaaataaagtataactatgtgtctcagcttgggctgccataaccaaacaccacagactaggtgtctcaaagaacagaattttattttctcacagttatggaggaggggaagtccaagatcaaggtgccagccaagtcagttcctggtgagggttctcttcctggcttgcagatggccaccttcttgctgtgtcctcacatgacagagtgagcaagctctggtgtctcttcctcttcctataaaggcactaaccctattggattaaggccccacccttatatcctcatttgacctttatcacctccttatcaaccctatctatctccaaatacagtccatattgggaattagggtttcaacaatatgaatagggagggagagcacaattcagtccatagcactgtagaatacgtgtttctataataataatggggtagctctgttgtttctccaagctgagttctagcactaagcaaagagtcctttatttagcagacgtttgattgttgtagtgttcatagagtcatgggcttatcgctcgttttaacttcttgtcctgccatcttggaaagatctatcaggagacataatcagcctatattatgaaaagagacctggaagtgagttcatggaagtctaaatcagtaatttagaggatagtgacactcaatcagtttgtagtttgcagtgcccctaatctcatcctaatgacctacaggaattttcagtgaaataagataggaaatcaattatcatttaccctcttcctgtggttttgggaggccaccctctaccttcttgcctttttgtctaagcctttctaatcagcatttacctcccactttgacttcaaggctttgggaaaataccaagtagctcctctcctgaagtaaattttatgtaacctattcccttcattgagcaccacagactgactctcaacccaaagtcttccaccagccaatcagtgcacatcctgtgtcatcaatgtaaaaatctgttaaaaatctgcatttaggttgggcacggtggctcacgcttgtaatcccagcactttgggaggccaaggtgggcggatcacctgaggtcaggagttcgagaccagcctgaccaacatggagaaaccccatctctcccgaaaatacaaaattagccaggcgtggtggtgcatgcctataatcccaggtacttgggaggctgaggcaggagaatcacttgaacccaggaggcagagattgcagtgagctgagatcatgccattgcactccagcctgggcaacaagagaagaaactccatctc

SEQ ID NO: 93465 - DNA, 867 bp, Homo sapiens
ggaagatattcctcgggagaactactcagctcagaccccagcgtcgctataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaaaaaaaaaa

SEQ ID NO: 93466 - DNA, 572 bp, Homo sapiens
  misc_feature (7)..(8): n is a, c, g, or t
  misc_feature (11)..(11): n is a, c, g, or t
  misc_feature (345)..(345): n is a, c, g, or t
  misc_feature (410)..(410): n is a, c, g, or t
  misc_feature (553)..(553): n is a, c, g, or t
attcgtnnacnagtggcgaggcggcggtcaggtgggatgctatggaatatgatgagaagctggcccgtttccggcagcccacctcaaccccttcaacaagcagtctgggccgagacagcatgagcagggccctggggaggaggtcccggacgtcactcctgaagaggccctgctgagctgccccctgggagccggaattccgctgccctgaacgcgtgatggatctcggcctgtctgaggaccacttctcccgccctgtggtctgttcctggcctctgacgtccagcagctgcggcaggcgatcgaggagtgcaagcaggtgattctggagctgcccgagcagtncggagaagcagaaggatgccgtggtgcgactcatccacctccggctgaagctccaggagctgaangaccccaatgaggatgagccaaacatccgagtgctccttgagaccgcttttacaaggagaagagcaagagcgtcaagagacctgtgacaagtgtaacaccatcatctgggggctcattcagacctggtacacctgcacaggtnggccgagaccagacgagga

SEQ ID NO: 93467 - DNA, 273 bp, Homo sapiens
catctggtagaggggctatcatgatgatcaagcgcggtgtcgctagaagtactttgtaagctagaaatcatctaaaggagcttccatttcacttacatctcatttggtgaatgagaatgtaggagtgattgtcagtaataatagcatccaccattagttgaacagtcaattaaaataatcgaaagaaatcaattgaaaaaacaatcacttttgcaacagtattttgtgaaggaatatatagactattttgaatcacttcaaaagttactgtaa

SEQ ID NO: 93468 - DNA, 248 bp, Homo sapiens
caagacataacttacttgatattgaatcagcctaaaataagatggtccttgtggaccataaccatgtcacaggacagcactgccttgggtggcacagtgtagagtctggaaatgccatgattgtcacaggacagcactgccttgggtggcacagtgtagagtctggaaatgccatgattgccacagggaccttcctgttcagggtagcttttactatccatacactatgcctcctatccgcttactgt

SEQ ID NO: 93469 - DNA, 348 bp, Homo sapiens
ggtttcactgggtgcagatacctagcacacaaagcagtcctatttgcccatctatggctgagcagagtgagctcacagtcagtgaccccttcccaggccccacccccactagcacaggagttcccgctgtgtgcacccatggcgtggctctggggtggctctgggtggccctcatcacttggactgccttttcttcttttctcgtctgccctcccctaagctgtagctccatttctgtcttgcacgctgctgcagcttcagcacccaccgtggtacctggctcgctgtggtgttccgcacatgttgttaaatttaaattgttaaatgattggatgagcctgacgtgag

SEQ ID NO: 93470 - DNA, 742 bp, Homo sapiens
atatgtgtatatgcacatacatagaaatgtattgggtaaatacctatatatttgtgtaacatacatactatatatgtatatgtacatatacatataaacatagacatatacatacaaataaaatcactatgtctgcaccaggatagagaacttgaccacctaaattgttgttcaggtgttttgaccaatgatacatcactttacagaataattcggcaaactttaaatcatttttgtcaattttactttttatgaggagattcatttagcaatcaagatgatccaccctcagattctgagtgttgatgacatgtgacaattggaataaagcagtttggagtggggatagctaggttgccatcatgaatctgcatagttacaagaaaaaccagattaaagttatgatactggaagagttcccaggtctctgtagatttcagaaccatattgatgagtaacagagggtttaaatgatcaacttttctagcagtgccagttcttccactgtacaaatctctaaatatttgttctaagaatccacataaaaacacaaaagccatcttacatataacattaaatgttctttgggaggccgaggcgggcggatcacgaggtcaggagattgagaccatcctggctaacatggtgaaaccccgtctctactaaaaaatacaaaaaattagccgggcgtggtggtgggcgcctgtagtcccagctactcaggaggctgaggcaggagaat

SEQ ID NO: 93471 - DNA, 455 bp, Homo sapiens
atggaaaggctgcacccaggctctgaatatagaaaagacccggcttcaaggaaaggagaaaataaagggtgccaataggccacggcacatggaatcaccacgtacatctgcatgtcttaaggagaagggaagagggtacgggaacaaaatgggccaccagtgcctaagccaggtgctccatgaacttgatctaattaaatcctcacaacaatgaagctctgaagaaagagagagcagggtgaacccactagaggacaagtgaaagcatcggatagggccaaggggaatgcaaagtttttaccttcaaactgcaaaggcagtgctcctaagactaatatttttcaaacattttgactaactcagtacgaaataataggttgtacttcccccgctgccctactccaagacggagttttgctcttgttgcccaggtgggaatgcaatggcacaaactc

SEQ ID NO: 93472 - DNA, 553 bp, Homo sapiens
gttcttttcttctttttttctctttcagagtgagaattttttattaatctattgcatagtaattattcccttattagctatacatctttattttaaatatttagttgtggctttagggtttacaatatatatctttaacttatagtctatagtcaaataatattctacatttcatgtaaaatgtcagaactttactgtagtatatttcgattacccctttccatgctttgtgctattgttactatatattatagttctatatataaaatatactccacagtacactgctattatagttgttttagaatatctttttaaacagctttattgatatacaattcagtcatttaaagtgtacagttccatcatttttctatattcctgagctatgcaactattaccacagtaagatttttgggtccttgttttttggctttgggttttttggagaaccgaacccttcactactgttccttccaagtcttggatatgcggggggtcccaatctttgggtttttgttgaaacccttcccctttccgggtcccaaccccc

SEQ ID NO: 93473 - DNA, 548 bp, Homo sapiens
  misc_feature (522)..(522): n is a, c, g, or t
gttcttttcttctttttttctctttcagagtgagaattttttattaatctattgcatagtaattattcccttattagctatacatctttattttaaatatttagttgtggctttagggtttacaatatatatctttaacttatagtctatagtcaaataatattctacatttcatgtaaaatgtcagaactttactgtagtatatttcgattacccctttccatgctttgtgctattgttactatatattatagttctatatataaaatatactccacagtacactgctattatagttgttttagaatatctttttaaacagctttattgatatacaattcagtcatttaaagtgtacagttccatcatttttctatattcctgagctatgcaactattaccacagtaagatttttgtttttgtttttgtttttgtttttgagacggagcctcgctctgtcctccagctgagtgcgtgcgcgactcgtcgtgagcttcgctcggtcagcgtctctctagctncgatgtgatgagcctcacagccgctc

SEQ ID NO: 93474 - DNA, 526 bp, Homo sapiens
gttcttttcttctttttttctctttcagagtgagaattttttattaatctattgcatagtaattattcccttattagctatacatctttattttaaatatttagttgtggctttagggtttacaatatatatctttaacttatagtctatagtcaaataatattctacatttcatgtaaaatgtcagaactttactgtagtatatttcgattacccctttccatgctttgtgctattgttactatatattatagttctatatataaaatatactccacagtacactgctattatagttgttttagaatatctttttaaacagctttattgatatacaattcagtcatttaaagtgtacagttccatcatttttctatattcctgagctatgcaactattaccacagtaagatttttgtttttgtttttgtttttgtttttgagacggagcctcgctctgtcctccagtgagctgagattgtgccactacactgcagcctggccacagagcaagactgtctctcaaa

SEQ ID NO: 93475 - DNA, 769 bp, Homo sapiens
gagtgtgtagtctggaagggcagcaaaagtcgagtggagtgagaggttcctgtgtcctggagcactgagtagagactccctcatgggggtgaatcttaaaggataaaggggcctctataatgaaaaggaggaggatgggatttctggtagaggaaattgcttgagcaaaacctccaaggttggaatgactatggtgtgttcagggatgttaggagacccagatgggtggagcgttgagtgtgtgtgtgtaggaaggaagaggggaggtggctggatgagcacagtgagacctgatttgattgagagccttgaacgccacgctgaataatggaggcaatgggactccatagagggcttttgagtagacatatatcagtgtagaagggtgaatttcagatttttagacagaatagagtaaggagaggagctcttagaaatcatctagtccagggcttgtggcagagccctgaggttttaagaaggcatgtcaggggctaccatgacaggcacggagaggctgagtgaattggggttcttgccacaattcccttgcctgagattcaacaagagcagctgtattacaatctgtgcaaaatgtcattaggagaaactagttagtagctgggcgtggtggcatgcaactgttgtcccagctactcgggaggctgaggccggagaatcgcttgaacctgggaggcggaggttgcagtgagcagagactgtgccactgcactccagcctggatgacagagcaagactctgtttcaaa

SEQ ID NO: 93476 - DNA, 855 bp, Homo sapiens
gctagaggtgaggaagtccgatttgacttctgagttatttggtgtgcaggataaggagcaaaaagggtatgaagataactcaggttttgagattaagtttccggggcaaaggtagttcatatgttaataaattaggaaaaaagagaaaaaggtgttggagcaagaagaggaatatattcaatttgaagcactggcaaaacattaaaagatgtccaggaattccagtctggaaccccagttaggggctggaaataaaaacatgtacttggaagtaattagcatggaggtgccaagtaacattgagtgaatgaaagaagagcagatggtgaaggaccgaattttggaagtcacccaacaaatatttatcaaacaagtaacatatatcagggactcatcccagtgccaaaaatacagcagtgaacaaagtagatgaagtacccccttttacatgaggaatatggctggtatgaaagtgaggtgaaggagataatctgataagagagagtgagagaagacaggaagtagacattcttcataagaagaaatgggtacagaaaagacacagagggaaataggtaaggcttggagtcaagcagaacagagttaaattacattttcctcactttgtagaaactctgatagggatcaagttactgaacctcagttttctcatgtatataaggggaattatgattatttattgtgaggattgaataaataaaatatgttgagtgcctcactcattgtaaatagttcattcatattagtctttttttttaatggcttcttcccatcctcattgctgagaaacttgagagagaacaaatacctatacatctctaccatgataggcat

SEQ ID NO: 93477 - DNA, 1147 bp, Homo sapiens
gagtcctttaaacgctgtcaggagacaagattccacatgctccctccatcagctctcccgagccaagaaagagaagagcttgtttaagtttggaagactcccattggcatgtcattgaaggtaagcccccttttaaatatttactgttaatgattctggatcctatttgtattgaactgaagatcctctaaagcccctggtcttatttctccaatctctctccaggggtgttcttacatgtcgtggggtgcagaccctgccaacttccatgctgagactcaggaaagaggtttgggcttgaagcttgtatgtcccagagaaagaaaaccctaatgtggaggtgagtgtgttgatgggttagaagtccagatgcctcagccagcaccttccttcccttttcgtttttttattttttttatttttttaaccttttgtccctctgtatttctcagaaataaaatgctctttagatggatttggattgtgtctttttttacagtctactatgaggcagtcttttgttctgtagatcctggtgttctctgtttccgtgtgagaagatgaaaaggaatgaaattccccaatgcaccctcttcccctaatgtcctacaccatctcaatgtcctttggctttaattgtgatccttctaggccttggcgaagatggcactgggagtcctctctgattctggtttcttttatgaacttgcaaatagtctatcccaaggatggaacttcagtcctgtcctcaccttttcctggcaaaaatgcccataaggttagaaacaaggctattcccattctgcctgaggactgtcgtagcctcatcccagctttagcctttcttctctgttgctaaactgtgtgatttggcatagcaaggctttgtttataagaagaccttctggttatttatatagaaacttttcattttcatgacttcattttgttctgagagcatatccgaagattctgtccggtggcaggcccaatcagtggattcagcacaagggagttttccatcttccttgggaaagacggcaagcaagctcagttttagtttgggagagaattagtgtagaatctctaaagccatctctatggtaagtccatagatttccaggaataaaacacagtgaaacctatt

SEQ ID NO: 93478 - DNA, 993 bp, Homo sapiens
gtgctcaaaaacagagtctctctgtggaaggccagttccccaatcccagagagcgtcaaatgaagagaggtaccgactcctgtcccacccaggacgcagccttcagcctccagccttctgaggcagagtaggcatttctgcacgtctgcaaaaggaagggagggaagcactccatcatctcactgggaagaacggcacgggcatacctgcagctactggggttccactgggcttgagggtcgatttttcaccttttgaaggacaagatgcattggaagatgttgctgcttctgctgttgtattacaatgctgaggcttctatgtgccacaggtggagcagggctgtgctcttccctgccgcccaccggccaaagaggtcctcatcactgccattgaacccagtcctgcagacctccctggaggaggtggagctgctctacgagttcctgctggccgaacttgagatcagccctgacctgcagatctccatcaaggacgaggagctggcctccttgcggaaggcctcagacttccgcaccgtctgcaacaacgtcatccccaagagcatcccagacatccgccggctcagcgccagcctctccagccaccctggcatcctcaagaaagaagactttgaaaggacagtgctgaccctggcctacacagcctaccgcacagccctgtcccacggccatcagaaggacatctgggcgcagtccctcgttagcctcttccaggccctgaggcacgacttgatgcgctcctcacagccgggagtacctccctgagagactggcccacaccaggacctcagagcagggaccagcacagtaatccagaaagtcttcattctctactccatttacagagaccagcaacaaaactcttaccgctgacacagagcagcagagatcaaacagtaaccccgatgctcttttctccttgtagtttcctggaagacacatctgattcatgccatcatgtgacctgggc

SEQ ID NO: 93479 - DNA, 209 bp, Homo sapiens
acagaatgagccaccatctcagcaggtgccaggcgtgagccatgctagaggtgctgctgcatagccaggagcaggcccatgggctcaggcaccctagtcccaggctcgcttctcctgctatacctcgacttccactgcagaagacagtgcttgggcaatgccatcacctgccctcctagcccactgtcatctcggcaacatcgtggcag

SEQ ID NO: 93480 - DNA, 463 bp, Homo sapiens
ccaggttcaaacaattgtcctacctcagcatcccgagtagctgggactacgggcatgagccaccatgctcggctaatttttgtatttttagtagagacagggtttccccatgttggccaggctggtctcgaacttctggcctcaagagatccacccgcctcggcctcccaaaatgctgggattacaggcgtgagccaccgccaccggcctcgcatttctttataagaagtacaacaagaaaatgcactgacctaactgcaaaattaccctgggctgattttacaatctccagccttagccttgaaaacactgtgtaaagtgtgtggcttcgcctgcaaggctgatgggtgcctcgggtggtgaggtggcaaagacagaaaggcaagcttcttctgtagcatcagatcacttagggacaaccctgtttccgagttgctcaggttgaagcatgccacaattaaga

SEQ ID NO: 93481 - DNA, 369 bp, Homo sapiens
gccagactcgactcagagcccttcctcacgattcccacctgttcctatccctcccctggctcccaaactgtacatcacggcaccctggggcaccgcagcctagttcaaacttttaaacagaacgtagcagtaattaacacctgtcagacactgagcaaacgactagctcgagcgagttcagtctcaaccttagtttctgccacagtcccatctgtgtgacaccatcgctctgtagagctgggatttcagcagttgctatgaaaaatagcaaattccaggcaaaaatcaggggacagaaactgggggggagtgtccatctgattccaggtctggaagatgtgtgaggcccaaaaggtgtacccatatcat

SEQ ID NO: 93482 - DNA, 340 bp, Homo sapiens
ttttgtgttttttagtagagatgggatttcaccatgttggccagtctggtctcaaactcctgacctcaggtgatccacccacctcggccttccaaagttctgggattacaggcgtgagccaccgcatctggctgtatttcttttttttatcacattaataccaaagctgattagcttctttataccaagagggtccagtttgccatagaggaatatggactttctcttggtttgtgagaaatttggattatgtctcactgaacctcaaaaactagatcataaataagaaataatagtaacaataataattaaatgctttatgtaccttaacttatgtacc

SEQ ID NO: 93483 - DNA, 1031 bp, Homo sapiens
gtaacgaaagtaagataagcccgttcttagcgtggatcattgtcctgattacacgccttaagtgattttatctggtcgatgtctgttttatcaagtagaaccgagcccagctcccccagttttttcttttatatttgtaatttactctcgagtcgcacaccttatccggcatctttccttccttcactgcacagtgcaccttggagccccttgcgcatccaattgaggcacctcgtcgttttaatgtctggatagcattgcaatgtacactgcaagcatttgtggtgattcgtaattacaaacaacagcctttcctctggctggctgaagcagactagaaacctgtgggaggttgtggagcggctcccctcgttacaaatccggaaaaccattttcccatggtggtaaaagctccaggaccacaattgagcctgagctttaatttcagtaagcttatggcacaacttcatgatggcagggtctcaagactggtacgggcaatttacactaattaccccgaaggaatgtccatagtcccgagggccaaggaagcttgaaagaagggcggtagggccggcgggccagattgggctttcaccggcagccgagtgtagccccgccaggcctcggtgcgggaagtcctgggtcgaacccttgctgaacagtgtgatcttcatttgatccaccggaatgtccgacgctgctgtcggggttactatcactcttgtgctttttttcaaaaaatggggggataaccggggaccacatctcattcagcgttgcctatgaacagtaacccacacactgcctggcaacgcagcaagcccgcttaaaggggccaaggcccctgggacaggacaaggcactgaccgggacgccccgggacacgcaggcgaagcaccgaagtcgccccgcactagggagccatggacacgatgcgcaccccgcagaaaccaaagctgtgtccccaaggagccacccggggcagccaaatgacgacaaaccggggtctcaaacaagccatgtgcccc

SEQ ID NO: 93484 - DNA, 332 bp, Homo sapiens
accagcattttctctcccaggatcattgctgcagactctcagcttgtatgtttcgagtgtactcttggacccagcacaatctgctttccacgtgtaacaagaatcatcgacttgaaacatacataaaatgaagccttccaaatggcttcccaccacactcagggttaaagcataaccccttgccagctcctacaaggctctgtgtatgcaatctgcccccacctgcctctccagcctcgttccccatcaccctcctctggtctgcagccacatggtctctccttgcagctctactggccctcagggccttcccccattctgttccctctaca

SEQ ID NO: 93485 - DNA, 305 bp, Homo sapiens
tcccagttactcaggaggctgaggcaggagaattgcttgaacccgggaggtggaggttgcagtgagccgaggtcacaccattgcactccagcctgggcaacagaatgagactctgtctcaaaaaaaaaaaaaaaaaaaaaaaaaaaaaaaaaaaaaaaaagtaaaattcttcaaataggtgcatcccagttcctgggggcaaggcctcaaaataaacctagtgcatctccctggattgtcagtttatttgaaggtttgtggaaaaaaaaattatcagattgtcagtttatttgaaggtttgtgga

SEQ ID NO: 93486 - DNA, 110 bp, Homo sapiens
ctaccacgtaagacatcccttgctcttccaccaggattgtgagacctccccagccacgtggaactgtgaatccattcaacttctttcctttatacattactcagtctcag

SEQ ID NO: 93487 - DNA, 340 bp, Homo sapiens
cctctattcctcaagggttttgcatggatggggtgagaaagaaaaggagacatacacagataattccttacgtggcaaaaggtaacaggtgcagactccagatggaacagggtaccataaacaatggggcaggggagtctgggcagcatcccgtcctggaccctgctggaggtggggtagggaaaatcaggcagaggtgtaaacaaggggagggtgtgtggggcagggaaggggtcaagagaccaagctgggtggagctcggggaataaagggagaaatagggtagaggtggaggtggtgtgagggaggaaattgaggaagaggagcctcggataccgag

SEQ ID NO: 93488 - DNA, 248 bp, Homo sapiens
ctttgcatggattgatgaatttcaagagtgtgcatgaattaaggtttattatgaccaacccagttcggggcacctgaggtcccccgacagaagtgagtaatgggacgtgttgggggtgcagaggaggagaggctggtcaattttgtttgtgcaagagtcagaaaatgttatatagaggggccctggagtgtcaaaggtgagcatcggccaggaggaagtgggagtggcatggaaggcatgcctgcagc

SEQ ID NO: 93489 - DNA, 775 bp, Homo sapiens
taaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaactgcagagcgcctacctgccgcacctagtaactgcagcgcgcctacctgccgcacctagtaactgcagcgcgcctacctgccgcacctagtaactgcagcgcgcctacctcctgcacctagtaactgcagagtgcctacctgccgcacctagtaactgcagagtacctacctgccgcacctagtaactgtagcgtacctacctgctgcacctagtaactgcagagtacctacctgctgcacctagtaactgcagtgcacctacctttaaaggcttttcaagaacatacagagcattttcaaaaactgaccatgtgctgggaaatcaaataagtctcaatttaaaaggattgtaatcataaaaatgtcctctgagtatatttcaattatgttcaaaattaattttaaaaaggtaattggaaaatcttatgtggttagaagtaacgaaatatacttttaaatatcccttggatcaaaaaaaataaatcacaatggtatttagaaaatatttttcactgaaggctaacaaaacactacatattaaaattataaaatgc

SEQ ID NO: 93490 - DNA, 890 bp, Homo sapiens
atacccagaaggaagtgatggctttagaaaaagtgagggtagttcccaagatagcctgcagcaggtggttccctttctgcgggagaaaagcaccatgcgtgggtgtctgcagcctggagggcatcgctcctctgagatgctggtcaccctccattggcagcaacagtggcatccctgctgtcactcggcagagtagcccctctcgctgagggtggtttttcctgcccgctctgtgctgcgcttgtggataagcagagaacgactcctatgagcagactgaggtcaggtggcccttcccagcgttagctcctggggacattcactactggacgcacttgaaaaagttgttgcaaagccccttgccctggtaggtgaagccctagtgaatgatggtctgttttatgattcccagttcacttgtccctttaaatggtcccttcctatgttagcactgcccccaggttctacctgttggggatgtttctcagtctcagtgtctggagtggagttcttagccatgaaaacactgtccctgacccaggccactcaacagccgacagtaagtccagctgaggctgccagaatggggcaggttttttggaaggtgtccccatcccttctgccccgagcatggtgagctgcaagtctctggaaggttcaccttagccagggcagcttcacacatggaggatgcagtgatattaaacagtcagcctgcagacatatcaagtaaacaaattatattttaaaagatatttttggccaggcacagtggctcatgcctgtagtcccagcactttggaaggccaaggcaggaggatcacctgagcccaggaagttgaggctgcagagagctgtgtttgcatcactgcactccagctgcttgacag

SEQ ID NO: 93491 - DNA, 340 bp, Homo sapiens
cccatcaacacagccttataattactggtttatgtagttgtcttttaaatcaggagacgcgagttacaaaaatacacgtatcctgtgtgttgtattacctgtgtagttacctttaatgggattttttatttcttggtgtggattggagttgctatatgatgtcctttcatttcagccatactaaatactctcctggatttcttgtggggcaggcctgataacagtcaacttgctctgtgtgtgtttaaaataaaaacatcggaatgttttaatttccccttcatttttgaaggataggttttttaatacatagaattcatagttgaacgtttttctttca

SEQ ID NO: 93492 - DNA, 354 bp, Homo sapiens
acacacatacaccacacacacaatcacagttctcaaacacatacacacaccacactcctgacacatgtacaggccccacagatcactcgcagatgcacgcactccacacacacgtctatttattgcgctggaaggaaacagatgctggaatggtgtagaaccggggcccggcaccttggctccccaatggcggctgcagagctggagccagcccctctaaggctgcagtggctgcgggtcccaggatgtgaacggaagtcatctaccctctccaggagaaagggcgagggaatgcaggacaggacaagggtgctctgggaggcccacgtgtgcggcaccacgccaggcctgccc

SEQ ID NO: 93493 - DNA, 281 bp, Homo sapiens
agggtaggggaggttgagagcttggacctctccccaccaccagatacccctgtttaggaccacaccctctagggtcaggggggccgatgtgactgatggaggcctgctgtccagagcaaaccagggtcaggcggccaggggagcatcggagggacgggcggccatggaagccctagggcagtgctgggagaagagggcaggttttcagcaggcagctcctcctccccttgttaaagccacagaaccaagtcagaggaccacagcccagcaaggcccattgg

SEQ ID NO: 93494 - DNA, 289 bp, Homo sapiens
tggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggat

SEQ ID NO: 93495 - DNA, 323 bp, Homo sapiens
tggcgaattactggaagatggcggttctggccaaaaggaaggagctattttaatttttattaggcagaggcagaaatggaaatcagggcctgctcaagggcacatggatgtgttggcgggtgtgtgtgtgtcgtgggggggactgggtgatggggaaagtggaagcatggcgaagtggagagagaagaggatatgggagtgaacagataaaaaagaaacatttaaaggaatcattttgggggttaaaaaaataactctaggtttgaaggagtatacaatttcccgagacttcatgaagtcctgccaacttcttccctctagca

SEQ ID NO: 93496 - DNA, 380 bp, Homo sapiens
aaatgatcggcatgcctaagacctattacactctaacatcatttcacatccatttcctctttttcacctcatttctttgtgaagtacccaggacaagttttataacttccactgtgctagtgaggaaagctgaagaagttggaggttaagttaagaggcatgcctaaacttacagaaacttgtgtgtagctgggcctgtttttcatttctgcttccctctcactggattgtatcctttctttcaaccattttatatcaggatctcccaaaattgtctaaaaattaatgttattttagttctttcctcttgtggtttgagaagtaattctccggtggctcatatttcaactgtagagcatgaacatcagcttaaaacttga

SEQ ID NO: 93497 - DNA, 320 bp, Homo sapiens
ccaaattctaatgtgtgcttgaaaattcaaattttgctattgaccacaaatattggcaattattttccttaaaacaacaatctcactttattagttttcaggaatgtttttgtgaaatacccgaaactgaataaccagtttgtatgtcagtcattcttttaagtaaaactgatgttcagtaaatatgtggttagtttagcttgcaactgaaataattgcacagtatttttatttttctatagaaaaccatgtgcactatacaatggaagtgttttatgcatatatctcactgcatcacatagaatattataaagttatgg

SEQ ID NO: 93498 - DNA, 331 bp, Homo sapiens
ggaggatcacttgagcccaggagttcgaggttgcagtaagctatgatcatcactgcactccagcctgggcaacagggtgagattccacctctaaaatgaaaacgaaacaaaaacctcacagggctaaggaaagattaccataaaaacccccaatacctggcccatggcaaatgcccaagatcttgtggaatcaatgactatacctgcaaatacgtgaaagatgaatatgtgtgcatatatgtatcgtagatggaaaaaacagatgaaaaacaacatattcaggatgatcatagccttatggatattgtgcagagaaaaatggctgatgagg

SEQ ID NO: 93499 - DNA, 430 bp, Homo sapiens
ccaccacgcccagccgtatgattacccttaagagttaactaccacactcaaaagaggcaagtagtaaaaaattaatgagtacaagctctgtactaataaatccctttgcattcataaagcagctttgatgacaggtcttcaggatccctgttcttctgcacatcagtttgttaatgggaaaagccaggttgggaggcagggctgtgcaggtcccccgacttgggttctagtggtgggtagagccaagaggaatgtgtgacgagtggcactttcaagcgggaggtagaaagcccagactggcacaagtcaaccatgctcacagcatgagctgctgacttggccttctctattctaatgagctgttttagggctgcagtaatttgttgacttagaattgtactcctgacttaaaggcgcggggctgcgtgtc

SEQ ID NO: 93500 - DNA, 393 bp, Homo sapiens
catctgtcagctcatggctggctttcttttatctgtctctctattcacttcacttcttactatattatttggaagcaattcccaggcatgtcatcattccatctacatatacttcactacgtatctataaaagatgagactctttagaataccattataataactaaataaattaacagcaaatccttaatgtcatcacatattcactgtgttcagatttccatttgtctttgtttctttcatagtctcttatttgaatcaggatccaagttaggtacatacattgcgattgtgataggtctcttcaaatctctttaatctattggttctgtccctttctttcttttatatttccttgcaatttttgttgttgttgaagaaattgggttgtcc

SEQ ID NO: 93501 - DNA, 722 bp, Homo sapiens
gacagcagatcaagggcatgagagagtatgtgttggcaatttaagatctgacagccagagaagtcaccactgagaagatgatggtggagtaaagacctggggaggtgaggcatggaaccctgagaatgtctgagagaaaagtggtccaggctgaggaaggagcaagtgcaaggccctgaggtgggagcgtgctcctggcatacatgaagcacaaccaagaggtcagtgtggctggagttagtaatctagggggagagtggtagatgaagccagaacaataccaggggctagaacttgtagcccattgttaaatgttaaacccaggagcattaaaattttaaagaatttatttgagcagatggtgattcatgaatcaggcagcactagattgcacgtggttcagggctccaccaagagggtgtgagggaatattttttataaggtgtttgtggaagccaagacaaagaaattatttgattggttaaagtggaaagtcccagttagaagttagttagtggtttcttgttggttaagcttaagtttcattttactgcttacattgacttgggttttggtttgcttatgtaggaatccaaagtgctggaaccatctcagcctaatggcttcctgatagattattttaacactgtttactgtgactaagacaggaagctatttcaaggcagaagaaataatagaaatgctgttacccttctccttat

SEQ ID NO: 93502 - DNA, 278 bp, Homo sapiens
tccctcttcctcctctccaaaagccaactcagatattacttcttctgcaaggccttctctgactcagtgtgatattatgatatgtgtatatatacctccagattttcattcatggttcctggctcataactcccatagcctttattatttctaaggcaggctatggaaactaaaaatatactctaatctccccacaacttgctttcttggagctgaccataaataatttatctgacctaccttgtctgattatgggtcataaaacccctatttcagaa

SEQ ID NO: 93503 - DNA, 400 bp, Homo sapiens
aaaggaactagaggagaaacctatgaattaaaaaagactttagatatctggaccaatcacgacatgtggattttatttaaatcctgtttctttaaaaataaaaacaaaaacaaacaaaaaaacactgacatacttaaaatcggaaatttgaatattgtctgatgatattaagaaaacagacacattatttttggtgtgataacggcattgtgattgttaccaaaaaaaggaggagtccttttcatttagagatatttactgatataaaataaatgttatttatctggggccaggcatgatggctcacaattgtaatcccagcactttgggaggctgaggcaggaggattgtgtgagctcagcaattcaagcctacaaaatgacaagacattatctctgcc

SEQ ID NO: 93504 - DNA, 225 bp, Homo sapiens
tcttttctgatttactttaaatgtgaaagaaaattctaagatgttaatattattattactgccattgatatatcccttataggaattaattaatagaaatagaatcaaagtaaatttagttatataatgcttagcatgtattatattctcaaaattctgtattcagtttcagacatgttcaaggctgaatatatgatctgacaataatctgcttatatagataaa

SEQ ID NO: 93505 - DNA, 369 bp, Homo sapiens
gagtcatgggtggtgagtcagagaggatgcttgaccattctgtgtacatgtgttggattcatgtcccctccctactttcagctccccctctctgccttgtgttataccagttattccctatttctgagctcacattcttgggtcttctgcgtcatagctcctctcaccaccagctcttcctgaactttcataaatatatggagctctcttgcctgatgataatccctctcctgatctcttttttcttatagatttattcctcttaattcctttgctttattttagtgggttcttggtagggagcagagagaaacagatgtgccacctttaactggatgcctgttggatggttttcagcaaggaagtttt

SEQ ID NO: 93506 - DNA, 440 bp, Homo sapiens
tctcgaactcctggcttcaaacgattctcctgcctcagcctcccaaagtgttgggattacaggcatgagccactgcgcctggcctcattttacgttttgatagctaaagctaaattgctttcttaaagaatgcagtttaggcttccagtgacagcaaatgagaatgtttccccacccaaagtggggaaattctgttcacaaaaatttccttgccaaaagtggtaaaaatttaaataattgataattatccaaactatttggtgaaaatcatatttcatggttttaatttgcattttctggtacatttagttgtaatgataccactgtcaggttttagtttccccacacatttacttttggtcgttctagaggcagtatctattgctgctaattgaggatactgaccactcttcaccataaataaaccatcacacttaatt

SEQ ID NO: 93507 - DNA, 1024 bp, Homo sapiens
  misc_feature (979)..(979): n is a, c, g, or t
actttgcacaaggttgccatgtttaataattcattcacagaatcctcaatctcacaaaagcctggaatggatttcctgtttggttatggcagggaagctactgtggccaggctccaactcctcccactgtagatagcagcagccttcttaagcagcctgtggccgggcacagtagctcacacctgtaatcccagcactttggaaggccgaggtaggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttgcttcnattggaagttgtaaaaatggtggaaataacgggcacccggggggc

SEQ ID NO: 93508 - DNA, 862 bp, Homo sapiens
tatgctgtgacacgtctagagctctactgcatgtatgcattcatgaaccatagttatatcagcagcgagctagtgataccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggcaagccagaagacttttcctgctggaggatccccgattaagagatgctgcaagccaaaaacgcggccaggttgatcgttcctatccgaggacagtgttgtcttccccgctgttaccgccgctgtgggcacatccgcctcgctcctggggggggg

SEQ ID NO: 93509 - DNA, 1708 bp, Homo sapiens
actttgcacaaggttgccatgtttaataattcattcacagaatcctcaatctcacaaaagcctggaatggatttcctgtttggttatggcagggaagctactgtggccaggctccaactcctcccactgtagatagcagcagccttcttaagcagcctgtggccgggcacagtagctcacacctgtaatcccagcactttggaaggccgaggtaggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcactccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcgatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaaaaaaaag

SEQ ID NO: 93510 - DNA, 1824 bp, Homo sapiens
actttgcacaaggttgccatgtttaataattcattcacagaatcctcaatctcacaaaagcctggaatggatttcctgtttggttatggcagggaagctactgtggccaggctccaactcctcccactgtagatagcagcagccttcttaagcagcctgtggccgggcacagtagctcacacctgtaatcccagcactttggaaggccgaggtaggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcagtaagtggcatggagttaactagaagcattgccaggagtttttctaaactaatagaggatcctctcatttggaagactatcccttcgatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaaaaaaaag

SEQ ID NO: 93511 - DNA, 441 bp, Homo sapiens
tccatggtgataatgaacttctggaatgtactagcagcaaatcttaaagtcaagccagtcgtttctaaaatattagtatgctacagtagatacagagattttaattaaactcacattcctaaagtatgtactccagaacttgaaaaagtggtatgcagatgtggtatttagcaagagtcaggatcctgaaaccttgttgaacagaaccaagtgtcctgatgcagattccagtaaacttttcattctgtgttcacagtctggggatgaccttttccccaaagatgataaaggtaatgccatcggtggaaaagcaacgttcttggatgcctgggaggtaggttcccagcttcctctaagtgtgctgggagagaaatcttcagttatccatgagattcgcatggatatgaatgaggccatgtgcctgatgctttctaatttcat

SEQ ID NO: 93512 - DNA, 1766 bp, Homo sapiens
actttgcacaaggttgccatgtttaataattcattcacagaatcctcaatctcacaaaagcctggaatggatttcctgtttggttatggcagggaagctactgtggccaggctccaactcctcccactgtagatagcagcagccttcttaagcagcctgtggccgggcacagtagctcacacctgtaatcccagcactttggaaggccgaggtaggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcgatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaaaaaaaag

SEQ ID NO: 93513 - DNA, 1621 bp, Homo sapiens
agtgtgatagctcaaacctgcaatcccagcattctgggaggctgaggagggtggatcagctgaggtcaggagattgagacccatcctggctaacacagtgaaacctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcgatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaaaaaaaag

SEQ ID NO: 93514 - DNA, 1325 bp, Homo sapiens
tatgctgtgacacgtctagagctctactgcatgtatgcattcatgaaccatagttatatcagcagcgagctagtgataccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcgatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaaaaaaaag

SEQ ID NO: 93515 - DNA, 1921 bp, Homo sapiens
gaatctgctatgtttcttgaccagtgcacataatgttttatgatttggatgtcagaggcttcattcttttggacatcatttgctttttatgttctgaaaaggatatggagagtagagctaaccatacttcacactcgagttgtatgagggactggggaggccttatatgtgtcaggcaggcattttttaaattttaatatcgtcaatattttcccccaaactgcccagtagaattcattgtattaattcttttgaaattacctttgaaaatagctattcctggagaatgtgcaagcttacataaggataaaggacaggggaggagtttgtaagccttgcagttccaataactaaccaacaggttattagacaaaagggaaggtgttttgtgcttctcagatgttgctggtttaggagtgtgtgatgatgcttgccagtgattttgtgttttggaaagggtaggtatcgaatgttaatcactttctaatgggtacctaaacagcaatgctgataaatgttcaaggaattattttcatcttagtttgttcttctcaaaaggcatcaaaaacaacttatttgaagctgcaatagagtgtagcattagcctgcatgtttctaggtcttctgccaagtgcttttctcagttgaaaactatttttcactagcaaaattggtattttatttcattacctgttagtaactacttcaatgatcatttcacaagaaaaagactataaattaagtagagaacaacatttttattgaacatttttggcttgcaatcaaactttgccactaaaaattaacttcataaaacactagtccgttatcaacttcttcacagagaaagtagctatactataccctacatatttatttatttattattctactatagcagaataacaaaacttgatgcattaagccagttctttgcaactgaaaattacctgtttctccttccctttcacactccatgtatatatgatcagcctctccattaaaaagaagctggacatgcaaatacatcatattatgttttctccatattttatgtttttctatgtatctgaatacagtgggataaataattgaaagtagtgttcctatggcattagtgtttttgtgagaagggtaaatgtagtgagaaaggttttttcatggcattaataagaaagcccttctgtaatatatatattattttgtaaacatttcactgaagggccaaaagttaaattataactaaatcactgtgttttcagaatgatatttaacaacaaacccgtggtcaaaccaaaatagtgggttgaagtgtattattcatcttttagtgcattggcaattgcaaaaaaaaaaaaggaatttaatataaggctatagagattaattcagtgtctaacatttgtatttatttaaatagttattgacctatgatgactttctagtcttaacattttatctttttattgttgttgttcttcctttcaaagatgtggttcttaataggttcactgaatgcacagttgaggcacttcttgtgacaccagttcccaagtagcgttaataattgggcctgtgtcataaaatgcacggatcattaataactaaatgtccctgacacttttcactacagggctggacttagtaactgaccaacttcggggggagggttggggcaagggggggtgggcgttagaacatgatcaaaaaatgtctccgctcagggatttatggtggattattgcagacagtgctaaaaatatagagcacaagacaagtttactaaattaaaattttattttttgagaaactgttatttgtataaattatcaagatttgtaggctttccttttgtagaaataattgttttatgtgccagagaatttcaattttgttttcaacaataaagcattgataagaa

SEQ ID NO: 93516 - DNA, 323 bp, Homo sapiens
ccaatctccgcaaactgtggaacatcatggaaaaacaaggcttaaagacttctaagacctgacacaggagggttggggcaagggggggtgggcgttagaacatgatcaaaaaatgtctccgctcagggatttatggtggattattgcagacagtgctaaaaatatagagcacaagacaagtttactaaattaaaattttattttttgagaaactgttatttgtataaattatcaagatttgtaggctttccttttgtagaaataattgttttatgtgccagagaatttcaattttgttttcaacaataaagcattgataagaa

SEQ ID NO: 93517 - DNA, 5084 bp, Homo sapiens
gatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttgccatactttgtctgaaaaattcctttgtgtttctattgacttcaatgatagtaagaaaagtggttgttagttatagatgtctaggtacttcaggggcacttcattgagagttttgtcaatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattc

SEQ ID NO: 93518 - DNA, 1351 bp, Homo sapiens
  misc_feature (613)..(613): n is a, c, g, or t
tgatctagaggatcccggtccccatgcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagnctggatattattcttgtagtttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttgccatactttgtctgaaaaattcctttgtgtttctattgacttcaatgatagtaagaaaagtggttgttagttatagatgtctaggtacttcaggggcacttcattgagagttttgtcaatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattc

SEQ ID NO: 93519 - DNA, 5123 bp, Homo sapiens
  misc_feature (4385)..(4385): n is a, c, g, or t
gatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagnctggatattattcttgtagtttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttgccatactttgtctgaaaaattcctttgtgtttctattgacttcaatgatagtaagaaaagtggttgttagttatagatgtctaggtacttcaggggcacttcattgagagttttgtcaatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattc

SEQ ID NO: 93520 - DNA, 1508 bp, Homo sapiens
ctccacccgacggggtggggaatgggagtgggaaggccaggagtgtctctgcaccatcactgtttgagtgttgcccctttgctgtgtgccccacctagtctatgtgtgtctctgttctctggggactcaatttgctggtgaattgcttccatggacattgttctgggaaacgccattttttctgctcacccatgactctgtgacaaggaatgacagcttattaggaatttgtttttgcattggaacagtggtcatcagaatgggccccttttcccttgcagctttgacatttgcctctcttttcctcacctctctcccttgcatccacccttttctctttttcttcttttttgttttccttctagcaggggccttttacctttacttgttaatcctgtttgtagcaagcaagtggaaggaggagttcctctctgatctgcttcttattctccacctaccttctcttctgtactttccgcctcctagagagagagagagagagaggaatgccgacctaactaccgctgccactgctgctgccaccaccgctgccaccaccaccctggtaatgttcacacgtcctcaaatcaacccagagccagggccctgctggtcagggggaggctatgtaaataatcccatgagtgtgccatcctcaggccctggggtctcctaggcaagaccagggcctctgtgggctctctcggaaatgctgaggttgctggaagccagcccgtcatacagggtctgagagtttaacttcttttaaattaaaccacagttgagctcatgctgtgtgtgtataaacttttgtatcctgctttttccttaaattctttatcatcagcatcttcccatgttatttcatagtcttcatcatcatcactttccataccttcatagtagttgatcgtagaattccatcataattaacttgtcttttctctcttagaagtcccttaggtaatgtccaattttccgtgagtgtaagtaataccataatggacatcttggagtctgaagtttattctgtgttggtttgttccacatttaggatcattttcccaggctagggatgatggggtgatagttccaggctggttgaggatggatttggagacagtcctttgtaccctcagtgagcaagagtatctgtcaccctacctcagcagttgtctctgtcactggtccaagcagctggttcctacacaaggtcaagatcaactggggagaagcagactcctgggtctatcccattagtgtggactgctgcctgggcttatggcctcattggtttggtttttatcttgatcatctctaccatccattcatcccggccttccattttctacctcagctgtcagtgcacagattgatgtgtgtgggaacggagcttgggaggagtgtggtagggctggtcctgtcctgtagcccacccttacttcgcgctcttgaatcctttggagcttacctaggtgggaggagaggaaggcacttgaaaagtccca

SEQ ID NO: 93521 - DNA, 440 bp, Homo sapiens
ctcttctctttctcctcttagttaccctccattgatatcctcatcaccatcagctccttctcctcccacctcacagttctctggtgaaattctcagggtgaaagtgagcctcagtgcttaggcagctaggacagcaggaagatggcaaacagccatctagagtgttcacgatagcttctcacctccccgagtaaggaagagctagaagcacttcctaacacttttatcagcatcatttagcctctagttcatgaggttatttatgaatcataccagcccctgcctgcatggcttcatggctgcttgctgttttgcataggcacccagctttattgttagtcatttccaaatgaggcctgggcccctggagaggcatgaggcctaactttaaaacaccgaaggacccaagggcagctttagcattgtgacacctgcaagtc

SEQ ID NO: 93522 - DNA, 102 bp, Homo sapiens
ggctataaactgaggtttaaaaaaacaaaaattatgtgtgaagtgtgtataaatgtagaaaaattatcaaaataatcaagactgcatatgtgtaagtgagag

SEQ ID NO: 93523 - DNA, 516 bp, Homo sapiens
tatatttaattgaaaaaagaaaatgaatcaatagaaaggttatgtacaaaattggatttgtgtatagggatgtgtacaaactgagtctatagggtacacatgacaattggttacaattttacaatcataatgtgtagtgtagagaaatcaacagcagaggaaccactctaacacattaagttccttggtcaaataaaagagattctcctgttgaataacagaatttaaaacattttcagtggtaggcaagtgtgttaatctttcctggccatagtggaaataaaggccgtagaagaactgagtgatgttattagcagtgcaaatagagttaaaaattgccatcatctagaactgacctcatgtgcttgggaaactgaatcttctcgccacagatggctctaatgagtcgggaggatggtgctgggcagaggtcagtgttggaagtcctttcttatggcaaagagtttgcagtctgtgcatgcatgtgtgtgtaagtgtgtgatgagagttgcagtt

SEQ ID NO: 93524 - DNA, 729 bp, Homo sapiens
  misc_feature (35)..(35): n is a, c, g, or t
acctcactacagaagatattcagatggcaaatgancatatgaaaatgctcaacatcttacatcataggaaattacaaattataataattgggagccccaatgttgggtgcagagatacttaaaattgttatatccttttgctgaattgactcctttatcattatataagtgacctttctttgtcttcttttacagtcattgatttatgtctattttatctaaatatagctactcttgctctttttgacctccagttgtatggaatgtgttttcccatccctcactctcagtctatgtgtgtctttataggtgagtgggtttcttcgtaggctgcatatagttgagtcttgtttctttatcaagcctctcgctgccttttaattggaaaattgagaccctttacattcagtattatattgataagcaaggacttactactgccatcttgttgcttatttctggttttgtaacttttgtcttcctttccccccccccccctccagcctgggcaacagaatgaaactttgtctcaaaaaaaaaaaaaaaaaatcatctgaaggtacaaaactctcactggttacagtaagtacacggaagaacagaatattaaacattgtatgtgtggtgtgtaaactactcttaagtggaaagactaaatgatgaactaatcaaaaataataaccacaacaacttttcaagaccaagtcagtaccataagataaataaaaa

SEQ ID NO: 93525 - DNA, 215 bp, Homo sapiens
gcccaggctggtcttgaactcctggcttcaagtgatcctcccacctcagcctcccaaagtgctgggattacaggcgtgagccacagcatccggtctatttgtgcattttaattaaaaagttctcagactaaaataagtttataaattttgattatgttactgtaattatgtgcagatattaaaaattgaaattatttaattttattatttaatcc

SEQ ID NO: 93526 - DNA, 288 bp, Homo sapiens
aaagcatgcatatcaactcagacttctctctcttcttataaagccaccagtctcttcacagggactctacgctgacatccttatcttaccctaattaccacccaaaggtcccacttctgaccaacatatgaatttgataattatctttccagcaaatgaaaatttcggggacacatttaaagcctagcaaggtttgaggtggagagggagagtaatttttaagtaagaaaggtaacacaaaaggcattttaagaatgatagccttacctcataaaaaataaaactttt

SEQ ID NO: 93527 - DNA, 875 bp, Homo sapiens
ataaacaacagaaatttatttctcacagttctggaggctggaaagtccaagggcaaggcaccagcaaattgagtgtctggtgagcctggttcatagatggtgccttcttactgcgtcctcacagggtagaacggtccaggggtctctctcagccttcttttataacagcactgatcccattcatgggggttacactgttgtgtcctgatcacttcccaaagattctacctgctaatactgttaccttggagattaggatttcaacatagaaatatttggcaggacacagacattcagaccaaagcagatgtgtacaccgtcacagcttcttgcttttatcttctatcttggtgacatgaattacttctggctatagtcactggtttgtcatcacattttctattgttggtagcaagcaatacaatagaggtataaataactcctaaacatttgtgtttttaaatacatttaagaaatgtttttttcctgagtagattgtgtttattcattaaccttattctttgaaacttaaaataagcttcaagattgtttaagatatgggaaatgaaagttttaacatctcttcggccttttattttaaggttgcctcttctctattttttcagttgaggaaaatgaagatgcaaagtgttagttgtcttttctaagtggcttgatggaagtatagacatgagttgcagtgtcaacactagcatttgcgcatagagcaaggttagccactgagaaccaggtctcagcatgtggcctgtccaaaatcaggttgacctaggtgccaccatacaaagaactctttgggtgacaggtatccagcctttcaggtaatactcagccaaggcctgtgccatctcatgtgg

SEQ ID NO: 93528 - DNA, 1458 bp, Homo sapiens
agagggaaactgaaaaatgaatttatctttctttaaatggaagtcagtttggtggttcatggcacctagtgtgaacatcagggtgagcccagaagagccatggaaataacaagtttccttcgggatgggtgaagagaaggcccagctaactcaagtccctggtattcagagccacatttgtgtgagaatttggggaaattcatgagagaaaatgggcattaccaatctatgtctcttaaccccggtggctatctctgagcagctctccctttccagcttggaaggttgtctgtgtgcagaggctgggagggagaagcactgcagtacgtgaatgaaaggtcgcagagttgtggctggaaaatacatttttcaccagggtagaactgagcccccagctgcctatcctggtagtcttttctgttcctttccttcccctttagagagctccatgttaatttatttcttatgggcaattatttattacttggacttttcatgtgtcttgtttatttgggggtggggggaggttaggggtaaggagggtaggtgatagaaagggaagttttaagatatcccagaccctatagccactggtgaaaaacaatcctggatggatggtaaattgaccaggggaagagttaggtttgaccaaggtttggattaaacaactatatttttgagagatggcttttcaggaagatcagggaatcctgagactggatagttagtggagggtgggactcattccacagaaatcgaaagttgtgatcatggagtttgcaattgggaagtaagagaccccagatttggagctgtgtcctcctgggatgatgttagatgttggctctctatgctgaatagtgaagctgtggataggcggttgctgggttgagggactgttgatttcatgttcgaaaatatcttcaggtggtccatgtaggcctggtgtctgctgcctccatctttgaaggaacatggaggagccctttctctgtaggagccctaagtctgggttttatcttaaaagaacacaccagtcattctgggtctccccttattgccattgccaggggagggtcgtctagtccttaagcataaacactggctgtcttcctactggtgtccccgccccctctgtatcccccaccccaacactttgccagacagttctttatgatgaacaaactttggctttagagctttaccacttacccatggctccctccttactgggcaggtggtgtacctgcctcttcccagcccagaaggcagcttagtcaggtcatcccagtagtagctcctacagctcttctgaccagcccatttccatctttggagggccttagcagactctggggtattgtcctcagagaagagacaaggagatgatggatggggtgcatgtgtatatgtgtgtttgtctgctgtccaataacaccaaaagtggaacttaaaaag

SEQ ID NO: 93529 - DNA, 399 bp, Homo sapiens
atctcctcacctgctcacaggccagtctcctctggaaacacccgcacagccacacccagaaacaatgcttccccggttctccaggtgttccttcatccagtcaagttgacacctaaaattcaccatcacagctggctggtgtctctggctggtttaggaaatgccgtttcccctattatttaaggaggtctgtggtgtttctgatcttgtctgggctctgggtttgttgtcattcattttctaaacagctgcctcccggctccccagtctctcatgttgtgggagtcattccttgggaagacaaaaagcattcatttattcgttcattcactcctccatccatttatccatccatccatccatctgtccatcatccatccatccagccattcatccact

SEQ ID NO: 93530 - DNA, 527 bp, Homo sapiens
attcttatgagttgcaaaatggaaaaggcctattataggcctcccataagcaacccagatgggaacattgtcactgtctgcagcctggcgtgctctggaaggcacttcctagtgactgcatctcccatctcctcagatgatactaatgagtttgctgctaactgaatgagcaaatactcccaccctgtttcaggccatcttttgtcactaggacacttgcaacagcttcctcactgagccctgtcttacatctggtccttttcccacatagtcagagtgacctttcagaatgcaagtttgattacgtaactgtcttgctgaaaatgtattgatggctgggtgcagtggctcacacctgtaatcccagccctttgggaagctgatgctaaggatagcttgagcccaggagttcaagaccaatctcggcaacatagtgagactccgtctctacaaaaaaatgaaaatatctgccaagtgtggtggtatgtgataatcctaagtcccagctactcaggaggctgaggtgg

SEQ ID NO: 93531 - DNA, 343 bp, Homo sapiens
atgatataacttctctagtatccaaagaatcaaccattaacagtttggtattctctatgaactattttgcacatataaaaatgggcagaaaacacaattatgtacataaatgtatccagctttttaaaaaaatgaaactgaatcatagtatatctggtctgtagcttgcttttttacctctacctaattgtatgcgaactactttctttgcagatcttaaaaaaaaaaaagaaaaagagtgttattcagatgaatggatatatcattatttaattattcagccatatattgatagatatttacaacgttttgtttttagtgatttgttagcatcttcgaatta

SEQ ID NO: 93532 - DNA, 652 bp, Homo sapiens
atcaaatactgtctcattatcatatgtttagcccccccaaaattacattttagactcttactttctctccctctcccctttctttagctcttgtttgtgtcttgccaaagaagtgtacctagtaagggaatgtttcttatttgtgccaagggactattgatgatgctgtataatggcaagatagcattttgtaatacctgcttttttatatttctaatacaaatgggcaaagctgtgaaaccaatttactaggtttttctgctttggacataattgtatgtgttaattctctctaaacagtgcctggcacatattacatgctataaaagtgttagctactactgctaccatttattattatcattattaaatatccattggttgaaaaaccaagtagtcagctaaatcatacctgctactgtacaaaatgtaggggaaaagctgagaaaaatcatttatcaataaacagttttcagaacaagaatttatactttggatatttttaaattgttaaatgttattgaaactttatgcaccaaaactgtatgaaataatttaattttgcagttgtgtttctatattctatgtaattaaagctacttttatactatattgatagttttaaataaaactggtttggaggtttgtttgc

SEQ ID NO: 93533 - DNA, 234 bp, Homo sapiens
cctttattatcaccacagaatttgaaatgatttctgtagtggccatatttcttttcagaacaagaatttatactttggatatttttaaattgttaaatgttattgaaactttatgcaccaaaactgtatgaaataatttaattttgcagttgtgtttctatattctatgtaattaaagctacttttatactatattgatagttttaaataaaactggtttggaggtttgtttgc

SEQ ID NO: 93534 - DNA, 900 bp, Homo sapiens
ctcatctaaaaattaccttcacagtgacatccagatatgtttgaacaagtatctggataccatggcctagccaaattgacacctgaaattaactgtcacatactgctagaccaaggaggggcttattttccccaagatgcctcaagaagttcaaagtgccagcgggacacagttccttctatctttctgcatggttatgccttgccatgggacttttgtcctcataggctacaaactgactactccatccctgggcatcacaggcagaagaaagagggaaggatcttgggcaaaaggcaaacactaacaaactgtgttatctgagtcttcccttttcaacagacttttttggaagccctgcctatcaaattcttattgatcttattgatcaaccgatatctttttgatgactcctagatgcaagggaggttaagaagctgattattttttatctaagttaaaaaagagagagagagaaagaaaaactcagggcaagaagtggagaataactgggtaggcaagtggtggcatcatccacaccaggtgttctgatgctacatcatttatgttttacatcccaccaaattgctcaccatacacacatggaggtgtctatccttgattggactgccctttatgttaatcactgaggtctctttggatatgtgaattgaacccaggatcaatgtgaagtcaccttcaatttaatggaagccggtagcaaaggaaggataaatttgctgggcattactttttcttttctgactcctgatgggctaagtagagaaacttttcattttaagctgatggaagcagcaaaaaatgaaaataaggatgaggtgtgaggggagggggcgggcattggtaaatgttcggatagctggtatattatatgggcca

SEQ ID NO: 93535 - DNA, 221 bp, Homo sapiens
ggcagaacttatacagttaattagcttgtgagcaacacagttaaaaactgtttttccaaacttaattttgtatttcaggtgcaaagctatttgaaaatttaagacagagtagcatggtttgatattagtgtttatggcgctttttatcatcacagttttgtttgttttgatatggggtcttgctctgtcgcccaggctggagtgcagtggcacgatcttgg

SEQ ID NO: 93536 - DNA, 125 bp, Homo sapiens
agagcaaaacttcgtcgaaagaaggaaggaaggaaggaaagagaaaggagggagggaggaaggaagggaaggaaaaaagaaatacctgaagctgggtaatttattttttaaaaaaagatgtaatt

SEQ ID NO: 93537 - DNA, 463 bp, Homo sapiens
gacagattttcaccatgttggccagggctgtctcgaattcctgacctcagggtgatccacccacctcagcctcccaaagtgttgggattacaggtgtgagccactgtgcccagcttaagtgtagcctttctttgtctaaactgaaagcccatatggttcagcaaaggctctccattctgcttggtcagagccacgtctgatttttgccacctctgtactctgttcagctcataggcttctgtcatgtctcagaattttgctctgcacatttgcagcctactgttcagccaactgttcagccaacttctagggctataatggctgatacagtagtcacaagttgtagctatttaaaattaatttataatattgtttcttacttgcatttgccacatttcaagtgcttagtagcacatggtactggtggctaccacattagatgtcacagatacaagttgcagaa

SEQ ID NO: 93538 - DNA, 207 bp, Homo sapiens
cttttctttaatcacatttagaaaatcacatttatggcccatggttataaatattctttgtatgttgataacttttaaatatatagctgcagccctcattgctcatctaaactccaggtttacctaactgcatacttggcatctccatttggatgtcttatgggtgtttcagacttaaagaactcatgattcttcccacaccccata

SEQ ID NO: 93539 - DNA, 437 bp, Homo sapiens
gggcatccggatggcgactgcgggaaatcgagttctcatgctggggcgaaaggtgtgtctgcaggagccaaatccaaatgagcagtccaggtacttcagagttttaacctgagcgaaacaggaatgtctcgggtcttaacaggaccgtccgcccgctcggaagaggcgaatctcccacggcagacgtctgggtgtgcgaatgccagttgagcggggcctcgaggacgcgtcacacacagcgaggatttgaggagggaagcgccttccagagcttcagagaagaggcagaagtgtgcaaacaggagcaggtccaagatttgcatggccagaagcaattcttgatcctcttggctagattcgaagatttggccacctccagacgctaccacactctgggacagtgggagatttggaacagctttgagaagagcaaggtg

SEQ ID NO: 93540 - DNA, 342 bp, Homo sapiens
gtttcctgaaatagagtcttacatccttaattaattaattctttaattaattaattcttttctaatgtatgtatttaaggctgtaactttaaagtagacagagcttacatgggtttttatattgtttcattcaaaatattttctaatttccattgtgatttcctctttgaccatggtttgttttaaagtctatttcttaatttctgagtatacaagaatttttaattttctctttgtaactacattattagaaaacttgttttaaattactttaatggtcagataaattatttcaacccttggaattttgttgtcttgctgtgtgcgctttaaaatgagtat

SEQ ID NO: 93541 - DNA, 632 bp, Homo sapiens
gcaacatctgttagaactttagaggtatagcattagcaaattacaggccaggtgcagtggctcacaactgtaatcccagtaccttgggagggtgaggcaggaggtttgcttgaggccaggagtttgaaactagcctggtcaacatagtgagaccccgtctctacagaagaaacatttttaaaaaatcagccaggtgtaggccaggtgcagtggctcacgcctgtaatcccaacactttgggaggctgaggcgggcagatcacgaggtcaggagatcgagaccatcctggctaacacagtgaaaccccatctctactaaaaatacgaaaaataagccaagcgtggtagcacatgcttgtagtcccagctactcaggaggctgaggcagcagtatcgcttgaaccctggaggcggaggttgcagtgagctgagattgcaccactgcactccagcctgggcgacagagcgagactccgtctcaaaaaaaataaaaaataaataaaaattagccaggtggccgggcatggtggctcacacctgtaatcccagcactttgggaggccgagttgggtggatcacgaagtcaggagatggagaccatcctgactaacacggtgaaaccctgtctctact

SEQ ID NO: 93542 - DNA, 364 bp, Homo sapiens
actggaaagcacatcagcacaccctcggggtccattgtaaacagcaaaatcaccaacaaaaagcaccaaaatgcaaaaaacacagcactaactacaccactaaaaagatacttgttttcagtaggagagtgaaacaaggaggcatagtgttgccttgtttgacctcaggaacatgaacatcaagtgatttcaaattttttactgctctgtgcatgtctacaaatgaccaaaaaagccccagacgtattgatttgggcttataaataaattttagtgagtaggtgcatttgcaagtatagctgcaaataatgaagactgactgtatttagagtcacaagtaactttgttataaattaccttttac

SEQ ID NO: 93543 - DNA, 223 bp, Homo sapiens
ctcctagctgttgcttttgcccagcaggataatattgagtcccactgcaagcacggacaaggcctctggttctggtcaccactaccttttcaaccgtagaacatcactggaaatgcttaatgcctggatctattttctaccaaaaacagttccactgggaagtctttcagtgggaaatgaataaatgttatacattgttatgttcagttatgtcaataagacc

SEQ ID NO: 93544 - DNA, 704 bp, Homo sapiens
ggcaaagatatttccatatttccccagacacccatttttagttcaggtttcacaggagacagattttgccaagcagatgtacttgtgtgaaatttgagaaacagcaatgaacatagtgaggtggaggttgtgctttcactattactactgtttcttctggcaataatgtttgtgaaattgaaagtagtaggaaacccacctacagtggtgtaagcaaatagaagcctatttttctcagatagcaagaagtttggatgtaggcaatcattggatttgtccatgagtttaccaatatcaggatcaatcaggatcagtatctgtgcagttttttcgaattttccttcatggctacaagaccattgttggagctgctttattcaaggcaaaacaaacaaaataaaaacaatagaaaaggaaaacagtaacatcaactatgtctgcctgttttatcagaagacaggttttcccagaagccctcaaaaccggcttacccaaggtctcactgtccaaatttgggcatgttaccacctgaaaattaggattctactggcaaggaaaaaggagggaaagttatgggagtgccataatgcatagaactcatagtctctgccctcaaggatctaatgatggcttgtagagcaaaacatatgcatggatatttgaataatagtataagagttaagaaaaaatataaggtaataata

SEQ ID NO: 93545 - DNA, 450 bp, Homo sapiens
acccacatcatagaaggagccatattgtaaagaagtcaaatgcagacttaaataattagaaaccttctgccagcgtgtttttctggcactccttctgtgtcgtcttccttatcgtctggtactggttcagaagcacttgtgtccatcacgtcatcttctgttaattcctctagtgtgttatctattagctcttgaatttctccaaggtgtatatcttgaaagccttcactcaccacccttttttccgtgttcacgatctctttcgtgatttccttggttggctgtattgtaaatcctgtcaagtcatgcacaacatctggacacagtttcctccagcaggggagtgtgttgtgttgggcttgatgctttcacagctttttgtgtaacgatggcatcttcagtgctgtgatccttccagactttcatgatgttctatcagggttctcttgc

SEQ ID NO: 93546 - DNA, 288 bp, Homo sapiens
caaagatccttttgtcagacaagggaacagcatgataatccaatggaactggttaacatgacccaagatgacatgaccacagatatactagtcgttctgaaacttgcccaagaaattgcaatcgtttcagcagaactccatgaaatattgacaaattaattccatcatcaaactaggagtgatattatcaggtaaaactatgatctcatgtatgtatttggtctttctgggtcacaatgtgacatgaaaaattttaaaggtcatattttagcaagatcaaaatgaatt

SEQ ID NO: 93547 - DNA, 458 bp, Homo sapiens
caactgaaataattctaagtatattctctgacaacagtgtaattaagccagaaattactaacagccagaattaataacagataatcctcactttttgtaaattttatgtatagttgacccttgaacaatatgggtttgaattgcatgggtcgacttatatatagattttcttccacctctgtcacccctgagatagcaagaccaactcctcttattcctcctcctcctcttcagcctattcaacatgaagacaatgaggatgaagacctttaagatgatcacttctacttaatagtaaatatattttctcttccttacgattttcttgataacattttcttttctctagctttattataagaatacattatataaaacatatacaaaaatatgtgttaattgactgttcatgcaattggtgaggctttatcaatagttaagttttttgggagtcagaa

SEQ ID NO: 93548 - DNA, 430 bp, Homo sapiens
atgtaatctcatgaattattatattggttcacatgtacagaagtcctgatttgtggccttatgtgttacttttttattttctacctgtctactctacttggcataaaacaaaattaattatacaatttaacaaaaataatgcatttctttaaacaagcatcctgaaagatgaaggtcatactataaacagttctagtagcctaacaccaaatgtactggcaggattcagcaggctcccctgtacaccagaataaatggcatttttactaaggtacatttctgagttgtagtatgataccttgtataacaaccattaaagcccacattaatccaattataagtaacagaggccatattttgaattggataagattaaatatatactttagacatttttagataagggaaaaatatttaaacaataaattaa

SEQ ID NO: 93549 - DNA, 408 bp, Homo sapiens
ttactccatgttctgtccccatcccaactctttggccccatagaatccccaagggtgggactcagtggcatcccttatagagtccaccattaggacacaggttcagagaaggatgagtgtatgccatcatatttcttccttagagaatttgacctaggaaatgataggagaaggaggccggtggcagaggtggctgaagctgaaggtttatgacacacagacagggtgtcatagccccctgggccctctggaacccaagaagcaggctgtagaaaccataagaaaacagaagcatacagatggaagagagggtgggccagctgggagcaggagaacagcacatgcaggaaaagctggtcgctgagaccatgtccccatgagagaacctggtcagtggctatcgaaagg

SEQ ID NO: 93550 - DNA, 116 bp, Homo sapiens
attaatatggtgccaagagactatacatatttgtgttaataaatgtgttcatttttgccattttgagaaattatactacaagaaagtatttttgttaaagaaaaaagagagtatag

SEQ ID NO: 93551 - DNA, 356 bp, Homo sapiens
ggcttgagaatcagtgcgaaggcagtgtaagattttggaaatcagatcgagagcctggatattattctaggatgacgggaagtatttggggtgataagacaagctaaaaagcatggcccatacatcttttccacaaagaccccaaactagagagatggccaacaagatggcaggtgtcctgaggtgcacgtctatcccttggtgcccctcacccaaagagccagactcttgaaagcactgatggcagctggctccttggaatgacatcaccaggggataccacggccacagcacttgccattgcatcagctccaacctggtcaagacctacatcatcaagacctcctccttcaccc

SEQ ID NO: 93552 - DNA, 573 bp, Homo sapiens
tgagtttggactcctctccatccttgctgccctgttcttgaaaatatagtgccttgaggggaccgtcactctccagaagtgacctggtctgaccatggaaaagcttggtggggcttcccctcccttgttctaatttctatgcatcttaagaaagtcacctaatctctttgtgcctcagtttccttattgggacagtggtgatagtactcattcctaaattgtttcaatcatctactgctgtgtaagaaaactccaaaacttattgcctacaaaatagtgatctgttatttgccatgataccgtggcagggatcagtggatgtttcttctgctctatatagcttggtccagagtcactgacacagttgcatttggcagctgagctgggctataaggtccaggaaggaaggcctcactcattcatctaggctgtgtggtttttctctcattcacgcttcctcatcattctgtggtccattcagacattcttacagaatggtggcggcttttcagagcaaagcagaaacatgcttggtttcttagggatgagatctaaaattaaactctaaggccc

SEQ ID NO: 93553 - DNA, 2670 bp, Homo sapiens
  misc_feature (1717)..(1717): n is a, c, g, or t
aacccatggccaattctgccctatccccattctctacccctttccatatttttcttctcccatattattttgaagcaaatcccaggcatcacataagatcaaaattttaacatgtttttacctctacttcaggttattgttgaaatgacctgaaattttaaggaagtagctgaaaatagcattaagattggaaagaaaggcagacagattatgagaggcctataatgccagccttgtggaggagccccagagttgtttcagtagacagacaaaatctggtctgtgctttagcaactttgtttcatgaatgaataattaacctagtgagagagagagtttcagaaagttgtaatgaaaggaatggtaatgtgaaagaggccctgaagcagcagaatttttatcactggatgattaattaaatgaggggatgagggaggctttgctaacctgaatttcaagcctgaatgaggttgatgatgacattaactaagacagcagacatggaaaagtaatgtgtggaacttagggttcttggattccaaagcagttgaaagggactttgtctagcttaagcaagaaggaaatttattaaaatattagtagggagaggagggacccctaggttgaaagggaagactgaagagccaggctaagaagtgtcagagtggcagtcagccagccggggcattgctgctagagtgagcgaatgccagctatctttagtgtttaggttgtattgcttatcatccattctctagggaggaagcattggatctccttcctcctatcccttcatttttactcttttgattagaggcaaacagggactttattaatgctctcttcaaactatattgaggggaaaaggtaattctgcagaaggaaatcaggttgctattgccgaaacaaagtagaatgttcagccaaagagtaacagttgtccactgtgtaacaaacctggctctgtacatgttgcatgtgtgttatctataaggcatgcaagtagaaatgtatagcagatagttggaaatgtggttctgaagtataagaagatagatttatatagtatactggattgattttccaagagtgactggattcttcttccctagagattttaaaaaaaaaaaaataaccctttatcttggttttgactgagtggtttaaagaaagtcagctctaaatccataacttactattggattgacttttgaagagcctttcctgtgctatggattcttaattcattttgaagatccaacagcagccgtgtagaccaccatcaagaaatgaacataaaagtcttttgattgaagccttaagatttttgcactggctcttctttctgcctgcaaccactagtctgctttatgtctctaagaatttgcctttactggacatttcatataaatggaatcatatggtatgtggccttttgtgactgacttcttttactcagcttaatgttatcaagggtcatccatgctaaagcatgtgtcagtacttcatttctttttattgctggataacatttcattgtatagatttgccacatcttatttattcattcatcaggtgatgggcatttgggtttgcactttttagctatttgaataatactgctgtgaccatttgtgtagaaatttttgtgtggacatttctcttgggtacatggaagtggaatttctgggttatatggtaactgtgtttaactgcngaggaactgccaaacttttccaaaatgactgccccattttacattcccaccagcagtctatgagtattctaatttcttcacatcctcagcaacacttgttattgtctctccttttgagtttagccatcctagtgagtatgaaggaatatcttgtttttattttcatttcattttcctactaatgatgttgaacattctttcatgcgctttttggttcatttgtttctttgttggggaaatgtctatcaagtcctttgcccatttttaagttggataattgtctttttattgttgagttacaagagttcttaatagtctagatgcgagttccttgtcagatatataatttgcaaatattctctcattctgtgggttgtcttttaactttcttaatggtatcttttgaaatgtaaaacttaaattttgatgaagtccagtttatctattttttgtcacttgtgcagccatatctaagaaatcattgccttacccaaggtcacaaagatttactactgtctttagtaaagacagttttctgttactaaacagaataccacagactgggtaatttctaaagaaatttacttagctcatggttccggaggctgagaagtctaagaacatggtgcctggcatttggttagggccttcttgctgtgtcataatatggcagagggcatcacatggtgagagggcaagcaagaacaaacccactcccatgatagtgacattaatccatgtatgagggcaaagcttttattaattaatctgttcatgaaggcagagggactaagtttccaacatgtgattttttaagggatacattcaaactatagcaacccctatgttttcttctaatagtcttatagttgtagcattacataggtctgtgatctgttttgaactatttttattttattttataattattatttttttgagactccgcctcc

SEQ ID NO: 93554 - DNA, 1107 bp, Homo sapiens
aacccatggccaattctgccctatccccattctctacccctttccatatttttcttctcccatattattttgaagcaaatcccaggcatcacataagatcaaaattttaacatgtttttacctctacttcaggttattgttgaaatgacctgaaattttaaggaagtagctgaaaatagcattaagattggaaagaaaggcagacagattatgagaggcctataatgccagccttgtggaggagccccagagttgtttcagtagacagacaaaatctggtctgtgctttagcaactttgtttcatgaatgaataattaacctagtgagagagagagtttcagaaagttgtaatgaaaggaatggtaatgtgaaagaggccctgaagcagcagaatttttatcactggatgattaattaaatgaggggatgagggaggctttgctaacctgaatttcaagcctgaatgaggttgatgatgacattaactaagacagcagacatggaaaagtaatgtgtggaacttagggttcttggattccaaagcagttgaaagggactttgtctagcttaagcaagaaggaaatttattaaaatattagtagggagaggagggacccctaggttgaaagggaagactgaagagccaggctaagaagtgtcagagtggcagtcagccagccggggcattgctgctagagtgagcgaatgccagctatctttagtgtttaggttgtattgcttatcatccattctctagggaggaagcattggatctccttcctcctatcccttcatttttactcttttgattagaggcaaacagggactttattaatgctctcttcaaactatattgaggggaaaaggtaattctgcagaaggaaatcaggttgctattgccgaaacaaagtagaatgttcagccaaagagtaacagttgtccactgtgtaacaaacctggctctgtacatgttgcatgtgtgttatctataaggcatgcaagtagaaatgtatagcagatagttggaaatgtggttctgagttagaggtggtttttttggtttctggttgttttcagggtgctggtcttttccagggttttaggaa

SEQ ID NO: 93555 - DNA, 573 bp, Homo sapiens
gggaagttaagtaacttgctccaggccagcctgctggtcattgatcaccctggtttcaaaccctgtttttagctccgagcttcctagttgggacttacttaatgtcacctgcattagaatgagttgtttacagtacagtctaggagcatcttatagtgatggagaacactgcctttggaatcatgcaaagctaggttcagtcttcgttctactacttatttctaccactttgagcaagttactgtatctgttataacggaggtgttgatagtagctcctacatttgtgaggacaaatgacaaatgaggtgttgatagtagctcctacatttgtaaggacaaatgagaaatgtaggtgtaataatacagagaaataatttcctggtagctagaaatagagttattttgggtgagaagttgggtaacctggcgatgggaacaccatcttctacagtcatttctttagtaaatttcctggtatttttgttgaacggggtgtgtaagctgagggggagatttatgaaagaagacgatgaatacagatgataaaattctaataaagtttctgctgtat

SEQ ID NO: 93556 - DNA, 131 bp, Homo sapiens
aaagctgatttggtagctactcttctctccccacccccatttgaaattagtaaattaaatttttattgtgaaatatttttgttagcctgagctacatggcaaaagcctatttctaccaaaacagataaaaa

SEQ ID NO: 93557 - DNA, 132 bp, Homo sapiens
aacgtcgagggcctcttcgtgtgtcatttactgtattaccagatgaagacagaaaaactacacggtcacagagatgcagtaaaagaatttgatgaaattccatacccacgtctagagaactttttttttttt

SEQ ID NO: 93558 - DNA, 568 bp, Homo sapiens
ggacaatcaaagcttagtagcttgagctggtcctggaagagcaagtaggagctctttagccagactaagagaagggcattcttggcagaaggaatattctatataaagaagtggagtcagggaacagtagggctctttgaagaactacagattgtgttctaaatgaatgacatgtaaggtttgtaaggggcgagtgataaccactgatgaatggcagatggtgttgacaactaggcggggccagagtctgtaggatcttacatgtcttgcaatcagttttgactttgaccttggaacccagttgaggctcccttccgccccagttcctcatggcagggaaatacatcatgttgtgcgttgtaagacttcaaaactttgctagtgagaggcctgcttaatattatttaatctagttcaatttaattgttttgaaaaaaaaaaaaaacaacaacttactttgaaggtactcttttaccagtttgggaattgctactacagacaacgggaagctactgaagttttatgtagagagggaaatggtcatatctggctgcatacagacttgaat

SEQ ID NO: 93559 - DNA, 709 bp, Homo sapiens
agagcatggaaatgacccagctgccctgctgttgaaacagaatcctatttggaaggcagacatgtggcccatctctgtagccatcactgagaaatctggattttcaagggcctttctctctgttgcccaggctggagtttagcgactcaatcatggctcactgactgcagcatcgacctccggggctcaagtgatcctttcatctcagcctcctcagtagctgagactacaggctcctccagatctgcctcctgctgaccttgtacccagctgcagcgacaccgagctcctcacagcttcccaaagtgggctggcccctctcacgacagggtcatcgcacaggctccctctgtgggggaacacaacgggagtcatttcaacaccactttcttcaggaagcctattctgatccttggtactccaagcagctgttgtcaatgcctaccccaggctgctaggaaatgctttccactcggaactgagacctaaaactggaaactaggctgcaggaccacctgggtacgtgtgaattacagaggttcatgcatttccaaatgggggtgtcattttagaactggggcgtaagatgatgagcaacagaaaagacaacgccgagcccccgggtatgagctcagaactctttacatgtttgatgctccaaatggtctagggcaggggggcttcagagccttggcagcagaacgtggtc

SEQ ID NO: 93560 - DNA, 556 bp, Homo sapiens
agagcatggaaatgacccagctgccctgctgttgaaacagaatcctatttggaaggcagacatgtggcccatctctgtagccatcactgagaaatctggattttcaagggcctttctctctgttgcccaggctggagtttagcgactcaatcatggctcactgactgcagcatcgacctccggggctcaagtgatcctttcatctcagcctcctcagtagctgagactacagatccctagaagactgtggccagcaggtattagcgtcaggagataaacagaactgagagcgtttgtcactagaagacttacattacaagtaatcctatagtgttctgcagactgaagagcgatgaaacgagatggcaattctgatgcctagaagaaatgaagacaaccaaaaatgatggtaagtatgtgagttagtaagttaagaactcttctctctctctctctctctccctcccctcaccacatatgtgtgtatctgtattttctaaaaaacatgacattttaacaaaaattatagcactttattgatgagtttacaagatat

SEQ ID NO: 93561 - DNA, 696 bp, Homo sapiens
tagactggataagagatgctcagctaagggagttcctggatggtctttagattgatacaccaatcctctgaaattgcatgcaaaaatgtaagtgtgtgtttttcttttcttccttttgtgcgtgtgtgtgtttctctccctccctccttccttcctgcctgcctgcctgcctgcctgcctgccttcctgccttcttccctccctccctccctccatctctctctctctttctctctttctttcttcagggcctttctctctgttgcccaggctggagtttagcgactcaatcatggctcactgactgcagcatcgacctccggggctcaagtgatcctttcatctcagcctcctcagtagctgagactacagatccctagaagactgtggccagcaggtattagcgtcaggagataaacagaactgagagcgtttgtcactagaagacttacattacaagtaatcctatagtgttctgcagactgaagagcgatgaaacgagatggcaattctgatgcctagaagaaatgaagacaaccaaaaatgatggtaagtatgtgagttagtaagttaagaactcttctctctctctctctctctccctcccctcaccacatatgtgtgtatctgtattttctaaaaaacatgacattttaacaaaaattatagcactttattgatgagtttacaagatat

SEQ ID NO: 93562 - DNA, 579 bp, Homo sapiens
tagaaatttcttcgatttggagactgaacactagtgagcagaactgaaattgagctttaaaagatattgatgactggtctgtggataggagactttagtgtggtttttatgcagacgtcctgccagctgtaaattccctggaggtttggtatgtgagaacataagactaaacttatttctattttgttgaggagaaatgattaaaacttttcattgatgtacttctgtggcagacttttggagaattgaaccagcgggcatattcagtatttgaagtcatagatgagtaaaggaggtatgttgtagtttgcgctggcggcgtggcctgtggtcggcagggcttatctgtgaaggtatgtgcacagcttcctaaggcagtgaaaagtcctggcagtgttagtattgaatgagataatccaaaaaatgtaaaaatgtttacatttttaaagggatagttggcgatttaaatggtttctgctaacaaatcagattattcattgcagaggtaaaatattttcagaatgttaattttagatgtcgtagagagtgtacatcagcaatgacaaggtcaacaaaata

SEQ ID NO: 93563 - DNA, 155 bp, Homo sapiens
gagattgcgccactgcactccagcctgggcgacagagcaagactgtctcacaacagaaaaagaagaaagaaaagtgactttgtttgggctgcccggcaacggatcccaagatagtgattccagagcaagttgtttacgtggaggtgaagaaaacc

SEQ ID NO: 93564 - DNA, 308 bp, Homo sapiens
cccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccatggaatcaacactcactgtacacaccaactggaccttcttgtactccatcaccatctcctcgagtgata

SEQ ID NO: 93565 - DNA, 442 bp, Homo sapiens
tttttagagacaaggtctcactctgtcacccaggagggtgtccattcttttgcatgaagctcctacactaggccctaacagaccagactaaaaatcaaaacagagtcaccatgcttaagttccacactaccaaactaaaactagttgttacctgacctcctgagaaattaggagaaagaagtgacagccactttctctaacaggccagtttcaatcttgaataagcttgatagtaaacttctctctgtttgcttgcttgcttgcttgattgattgattgattgactgattgatttagaaatggagtctcaaaaaacaaaaaaaaacaggactgtaaacaaggtaataaatggagattagagaactataggtatccttatttttcttctttctacttttctatattttcaaaatttgccatgtcttcattatttataatgaga

SEQ ID NO: 93566 - DNA, 448 bp, Homo sapiens
gatttgatccctccttccaggagaaaccttctggacaggcgtctttccattaaacactcaagaagcgttctaggtgaggggactgtacctccaggtttctcctgggcccacccggttcacacccactgtccctgtgtaatcatttgatgtgcccactatgggtaattggtgctacggttcccctgcacccccctcccgcttctttctgcagacactgagccacctgtgtgcacggcccctcggtttaggcggtgtgggttctcagcctccctggtgtgtctcgctccccctgcagcccagcagagcctctctgtgcctagctacagcacgctccggaaaatggcaaacgtgctgcgggctgggcaggagcagcttccccaggtgggaacacgcccagcatgcacaagtggcacggattgaattatgtcccccaaaatatatagagagg

SEQ ID NO: 93567 - DNA, 881 bp, Homo sapiens
aaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacaaatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccgctattgtcctgtgaccctgccaaatccccctctgcgagaaacacccaagaatgatcaattaaaaaaaaaaaaaaaaaaaaaaaaaagaaaccattcagtagccgggcacggtggctcacacctgttatcctagcactttgggaggctgaggcgggcggatcacttgagctcaggagttccagaccagcctggccatcatggcaaaaccccgtccctactaaaaatacaaaaattagccaggcgcactggcgtgtgcatgtagtcccagctactcaggaggaggctgaggcaggaagattgcttgaggccaggagacaaactgcagtaagccaagatcataccatggcactctggcccgggcgacaaagctagaccttatctttaaaaaaaaaaaaggccaggcacagtggctcacgcctgtaatcccagcactttggaaggctgaggcaggcggatcatgaggtcaggagatcgagaccatcctggctaaaacagtgaaaccccgcctctactaaaaatac

SEQ ID NO: 93568 - DNA, 2870 bp, Homo sapiens
gagcggagcgaagccaggagcccgatcgagatgatgatggttatgcagcccgagggtctgggggccggggaggggcgctttgcgggcggcggcgggggcggcgagtacatggaacaggaggaggactgggaccgcgacctgctgctggacccggcctgggagaagcagcagcggaaaaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgcttctgtggtgccagaggaagacagcaccgtaccgcaacgtcaacgtgcagaacttccacaccagctggaaggatggcctggccctctgtgccctcatccaccgacaccgccctgacctcatcgactacgccaaactgcgaaaggatgaccccatcggaaacctgaacactgcctttgaggtggcagagaaatacctggacatccccaagatgttggatgcagaagacattgtgaacaccccaaagccggatgagaaggccatcatgacctatgtgtcctgcttctaccatgcctttgccggggctgagcaggcagagacagctgccaacaggatctgcaaggtgctggcagtgaaccaggaaaacgagaagctgatggaggagtatgagaagcttgccagtgagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggaaaggaggagatgctgagccagcgcgactacgattcggctttgctacaggaggtgcgggcgttgctgcggcgccacgaggcctttgagagcgacctggcggcgcaccaggaccgcgtggagcacattgccgcgctggcccaggagctcaatgagctggactaccacgaggcagcctcagtgaatagccgctgccaggccatctgcgatcagtgggacaacctgggcaccctgacccagaagaggcgggatgcgctagagcggatggagaagctcctggagaccattgaccagctgcaactggagtttgcccggcgggccgcgcccttcaacaactggctggatggtgccgtggaggacctgcaggacgtgtggctggtacactctgtggaggagacccagagcctgctgacagcgcacgatcagttcaaggcaacactgcccgaggctgaccgagagcgaggtgccatcatgggcatccagggtgagatccagaagatctgccagacgtatgggctgcggccctgctccaccaatccctacatcaccctcagcccgcaggacatcaacaccaagtgggatatggtccgaaagctggtgcccagccgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcggaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtca

SEQ ID NO: 93569 - DNA, 803 bp, Homo sapiens
gccaagggcagagtcagatttgcccataggagagcactgccgtcagaactcatgtatgcttgtaaaagaaccaaataatatcaaggctaagtccctggattttgaacttcaaaaaccaaaccaaccaatcagttttcagggataggcctagtcctacacctttgccatcttcagagctaaagagagatagcagatcgtcaaaataaaatcttcaattatagttgtagtcactagccgccactcagtaggttctgtgcatttgagattgttaactaacctctgagcctcagtttgctcatctacaaaatggcaataatgatagcatctacctcataggctattgtgaggattgaatagaaaaggcacataaggcacttggcacagtacctggcagcacatttgttagataccaccactaccatcaccacaaccattaccaccaccattgtcaccatcatcatcctcatcaagacaacagtgaatgggaaaaagctcagtctctggagcctgacaaactttttttgaatcctggctttgccacttcacagctacgtggcctcagataagtgacaacttccttgaacttgattcttattctgtaaaatgggaaactcataaggctattgaaaagtgtataacatggttcttcacagtaagcactcaataaatgttagctattatgattattaaaaaggagtgatcaaggtcagtggttgcctggtgttaggaggatacagagatgaatgggctaagcacagagggtttctagggcaatgagactactattctgtgtaatactataa

SEQ ID NO: 93570 - DNA, 852 bp, Homo sapiens
tttaaattttttgaagcaatttcttaggtacatacatatttggaaatgttattcttcataatatgaacctttgtcattgtgaggtatccctctttatcacaggtaatacttcttaaagtttactttgtttacagttaatatagctgtactagctttattttggtatttgcatggtatgtcttttttttcccatttctttactctcagcctttctgaattcacatgtctcttataaacatcatatagataggttttctttttttttatatggcccaacaatcttcaaattttaataggagcatttcatctatttatatttaatatactcaccaatatatttgggcttaaaatctactgttttttatgtgctttttatttgtcctgcctgatatatgttcctttttcttttcttccttgccttttttgctctttcttgcatttttttactacttttttattccattttttcttttgtttggaagttttactcttttactattattttagtcattaaccaaatggtgaaaacagatctgtgatctatcagtatttgctaactagtagttttatctttttcccagataatacaggtgttttaatatgccttactgtgatatgattttgttcctctgttgttgtgtatcttaattatctgtatgttttaaattcaacacatcgctattatgttttatgcagtcactatttaaacatactcacgtttcattgcctttcattatttctcacacctctaacttttcttcgagacattttcaatctttccttcaatatttcctttagtgcaggtctgctggtgtgagattctcctcttagtctgtctgaaatgtctttatt

SEQ ID NO: 93571 - DNA, 491 bp, Homo sapiens
gccccacagtaggtgaccagttcccacggcttggggtcctccgtctgtcaccttgcagatacaggaggtctatactgcagaccctcctaaagcagctttctctaaagatgcaaaaaaccaccaagctgtttttagatgtgctatttgctgtttttctctagcagatgcgccaagtcctaaagataaacagtttaaaatgatatggattcagtacctggaatcccattgtccatttctatcaacactttttttgttgaaagcctgatcggttccagcccagtgacctccatagattggcatgactcccctaaagccccctttttgtaagtgctagagatccttgctgaaagctgtcaagggcactttcccatcctttgggtttaaacagaaagaccagctacatgtaaaagcccatcaccccaagacaacaagtggctctggtctgctagaaaggattcatgcagttttttaaaatgaactcagaaaagaaa

SEQ ID NO: 93572 - DNA, 246 bp, Homo sapiens
ttgcctggatactggtgtcagcctagacatggagctcactagccatggggccctctcctgcggaaggaccctctcctgcggaaggaccctctcctgaagaaagctccgggactttcctcctctctcaccacaggcccaagtggattcacaggctcccaagcccgtgcggtctgggctctctgttccctccagccacacgtcgctgccactgaccctgttttttcttttcttttttttttttttgag

SEQ ID NO: 93573 - DNA, 1902 bp, Homo sapiens
agtgaggtggtttaaatattgttcaaaactctgaaaatgagctctgatggaagtattccaatgattttgtgatccaagggatttgtgcaaagctgtctagcggtacaaaaagaataaatatttagcagcttgtgtttgtcttgcccctgagtaaagtatacaggagcctgtctctgtttacccatttaaaaattttcctggatctgtttaaatgatggtgcccctggcagtgagtgtgtccaagctcacttaggaccagagtggaagagcatggaacccatcaggtggccacacaaaagcctgcagttggcttttggctctgtcactactcaggtttttgggcaactccctttacttcttttggctcagatttttcatcagttgaaagaagggctgatattaagtccccttctaggtctgactctaagctaatatttattttattgccttaactaacagaagtaaaagagagaggctgcttgttatttaatgtccaaggaaattttatccagttgtgattacttcagctgattcaaaacagcgtccttagaggcacagggccgtgcagagcctggacccatgtaagacccctctgagccgccagcctgactgctctcagtgcaaagacccagaacccagccttccttcacctgaaacagctgcagcgtgcacacacacttcttgtgcatatatctctggtctatttattttcaaaactaagtataatccaaattgaatgctggaatcagatttttccattctgaatgtgtttaaataacatggccaaggataatttctttctgttttcttgacatttataggtagtataagatatgtgacttccaaataaacataaaccatcacacttcacgaaaaaagagatctttcgacttttaactgcctgtttcctatcttaattacaagtatttctaaagaaaaccattaagttctagagcttacagtacatggttttaaaattgtataagtgctgttaagagtattgattgccttttcttggtttaatattaaaccagggtgttctgccgaagaccgcatagtttctctgatatggttccaaagggatattctttccactgaaacactgtatgtatactagtaaatgcttcctaatggtagatgataaatatttttgttgcttgtagatagaatttttccatctagtgtaagcttaggattgttttctttttcccagtgacatgtacagtttcactactccacttaaaaaaaatcgttagctcagataaagtgtgtggcacatgaaatgaattttgccaattcaccaccgaaatccctgctttatatctcttcagtggaacactaaaccaacttctttcccaagtacactgatttgatctttacaaattatatgaatgtattaaattatcacatgtgccctgaaactgtgtacatctattatgtatcattagagagatggaaaaaaaaaaaagaaactgcttagtaaagtagaaaaaatagttttaaagtaattttgtaaggctaatggaagacttactgtataaagcaaaaaggattttaaccacattcaaattattgactgttttggggcttttcaggaatcacttaaaaagcaccaagttcacagccaggcacggtggctcatgcctgtaatcccagcactttgggaggctgagatgggcagatcacttgaggtcaggagtttgagacaagcctggtcatcatggcaaaatctcatctctactaaaaatacaaaaattagacctggtggcatgtgcctgtaatcccagctactgaggagtctgaggcatgagaaacgcttgaacctgggaggcggaggttgcagtgagccaagatcgtgccactgcattccagcctggggaacagagcaagtctttgtctcaa

SEQ ID NO: 93574 - DNA, 353 bp, Homo sapiens
ctctatacatcgagctccgtacctaagtcgcggtcacggttgagattatgttcagttgtatgggacgagtgttttatacaaatagaggcttatttacctcttatgtaaaagaagtctggagttagtgatccagggtggtagagaatgtatcactgacccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaaccccactcactctcta

SEQ ID NO: 93575 - DNA, 1084 bp, Homo sapiens
caaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaactgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggatggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactgacccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaaccccactcactctcta

SEQ ID NO: 93576 - DNA, 1797 bp, Homo sapiens
ttaaaagcacaaatacactacatagagaaaggcttggttcttatcaggacacaaatttaaaggctgtgtggacttggggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctagaaatacttggtcaaattttaacattataccaaagttatacccagttctacctacttgtatatttctttactcatttcaataaagtgtttgaaaaaaaaaaaa

SEQ ID NO: 93577 - DNA, 1886 bp, Homo sapiens
ttaaaagcacaaatacactacatagagaaaggcttggttcttatcaggacacaaatttaaaggctgtgtggacttggggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgagggaaatgatcctgaaacaaagaatgaaccttataagacaggcgtcccatgtgaagcctgcccaagtaactgtgaagacaaactttgcactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctagaaatacttggtcaaattttaacattataccaaagttatacccagttctacctacttgtatatttctttactcatttcaataaagtgtttgaaaaaaaaaaaa

SEQ ID NO: 93578 - DNA, 1902 bp, Homo sapiens
agtccagtttctttgcagctaccaggacagagcttggtgagataattcttttattcttcaacttttattttaacttcaatggtacatgtgcagggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgagggaaatgatcctgaaacaaagaatgaaccttataagacaggcgtcccatgtgaagcctgcccaagtaactgtgaagacaaactttgcactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctagaaatacttggtcaaattttaacattataccaaagttatacccagttctacctacttgtatatttctttactcatttcaataaagtgtttgaaaaaaaaaaaa

SEQ ID NO: 93579 - DNA, 350 bp, Homo sapiens
  misc_feature (238)..(240): n is a, c, g, or t
actgtatacatacactggaagttcaatattggtaagatttcaattttccccacattgattcattgatttaatataattccaatcaaaatgttatgaggttctttctcgtgccgctgaattccggaagatccccacatcgatgaaagcaaagcgaagcaccaagccatcatcatgtccacgtcgctacgagtcagcccatccatccatggctaccacttcgacacagcctctcgtaagnnngccgtgggcaacatctttgaaaacacagaccagggatcactagaaaggctcttcagaaactctggagacaagaaagcagaggagagagccaagatcatttttgccataga

SEQ ID NO: 93580 - DNA, 324 bp, Homo sapiens
ctcaaacacttctactttaatgttacctacatctgaaaactgcctttccatattacattcaatagcactaccacgttgctatgcctttcctccacgacactgtctgtaaacagatcctttaggtagtagggtaactgtgtgtgtgcgtgcgcatatgtgggggtgtggtgtgtgtgtgcgtgtgtgtgtgtgtttcttcaggtttaaagactaaactatctggaataagaatagtatcttatgattctttaaaattttgagcctgggctggcgcagtggattacgcctgtaatcccagcactttgggaggccgaggtgggcgga

SEQ ID NO: 93581 - DNA, 519 bp, Homo sapiens
agggaagagaaacaaacctcttccctcctgatgcttctgtaccagcaaaatcaaaagagaattaaatcttacaacaaattgcactgcttcagctattgacactgtcccacagaattcgagggacctcacctcctcgtttttggacgacagaggctgaaacaaatctttgctaagggaggctggaagttggggcaaaacattattaatgggtcacaggccagaaaggagagtcaatgagagaggattaatgaggccagatcatctggtccacaggctgggctgactcatcctgcattctgaggcttgatcttcagtgcacctacctgtgttggctcctgctagggctgcgtgagcctaaggaaataagactaaaaaaatcaagccttgtgtatgagtctgttttcatgctgctaataaagacatacccaggagtgggcaatttacaaaagaaagaggtttaattggacttacagttccacgtggctggggaagcctcacaattatggcggaaggcaagga

SEQ ID NO: 93582 - DNA, 197 bp, Homo sapiens
gaacgaggagacgcgaggaggagggaggaggaagagagggagggaggcgggaggagcgcggaatgaaaagctcggaggggcgaaaaagcagcacagcaaagcccaagttgctgagcgagcggagcgctcccgcggcccggagccgagcggccgccgcgccccggagcccggcccggccccgcccgctctgggccccc

SEQ ID NO: 93583 - DNA, 244 bp, Homo sapiens
caggctggggaaacacgtagcaaggaaatggttgggtcagactaaatacttggggtaaagctaggattcctgggttgctgagctccagtaaattccacactgaaatagagccctgggcacagtgtcctctgaccactacttacattctcctgtcatccatcgactcttcctccccaccatccacccactcgcccattcattcatctctccattcatttacccacccacccgtgcatccatctgt

SEQ ID NO: 93584 - DNA, 358 bp, Homo sapiens
tatgaaagtattgagtaaaaggaagtaaagccctctcagagtgttttgtaggctgtcacatttcactccataatgtcctagtgtttgttgccaccagtgatatatgaaggtacccactgaaatgtcacacctttttggttttcctttttaaaataaaaaataaaaaagacatttaaccatataatattgttcttatatatgatttattataatgtagattcacatctttgagttcataaaaatattgaatttggattctctccaatttcccttttagtagaaaggctaaagttcggtaagaaattctacttggaattttattgaattgagaaacatacttggatttctgtaactcatg

SEQ ID NO: 93585 - DNA, 371 bp, Homo sapiens
cgggaggcagaggttgcagtaagctgagatcatgccattgcactgtagcctgggcaacaagaacgaaactccgtataaaaaaaaaaaaaaaaattagccaggcgtggtggctggtgcctgtaatcccagctactcaggaggctgaggcaggacaatcacttgaacctggaaggtagaggctgcaatgagctgagattgcgccactgcactccagtcggaggggaagagcgagactccgtaagcctaaaattgctttacaaggaaaagcttattaattaaaaaaaggaaataaaagatagaagaaggaggagtcaaaaaggagaaaacgctggttctcagagcggctgtttttcttactatgttcctggggt

SEQ ID NO: 93586 - DNA, 552 bp, Homo sapiens
ataatatatttgataaataaaggatttgtatccagaatatgtaaaactttcttacaattcattaataagacatgtgaaccaatttaaaaatgggcaataattgaatagatatttcactaaagatatacaaatggttaacaatcgcatgaagatgctcaaaatcattagttgtcagagaaatgcaaatgaaccataatgagatgccactttgcatccactagaatggctacaacaaaacagaaaagtccaagtgccgacaagaatgtggaggaacctgaaccattcattattcattgctggtggaaatgtaaagagggacagccactttggaaaagcttggcaatttcttaaaaagttaaacctaaacctactatatgatcccagcagtttcactcctaggatctacccaagaggaatgaaaatatatgtctaacaaagacttataaatgaatgttcatagccgtattattcataatagccccaaattggaaacaatctaaacatttatcaatcggtgaatgaacaaaatatggtataagtggaatacaactt

SEQ ID NO: 93587 - DNA, 595 bp, Homo sapiens
cctgacctcaggtgatccaccagcctctgcctcccaaagtgctgggattacaggcgtgagccaccacactcggcctacgaacttctttattaatgtaatagcgcacatatacttaacttctggtttctacttaagagcatctcaataacctccgatatagaatacgatgaaaaatgaaacctgtgtgcataatgtgcttgtatctacctgtcagaagccctttgctttgatagcatttgctgcctcagtcttcctcatcacccaacctctctgggttgcttgttatgataaacctaagtgcctccgtaaatggttagagcatgtgtttcttcgtctttgtgacttcccttgtctgggaataagactgcttgtacttctcccagctttgccctctttggcctactagtagcacaccccatcgatccagacctgtctggctctttgtaacatttacctggtcacatgataaagggtgctgagtgcttgccagtgtgggtccctgtcacttctcatgcatgtcctataccttaattttaccacatgtgcttctgcttcttaaaagccattcaaataaatggagagggttttaattaac

SEQ ID NO: 93588 - DNA, 205 bp, Homo sapiens
ccaagatcttgtgtcaacagctgagatacacacacaagccccgttccctccccgttccctccccactccctcctctttccctcattctctgcatgcctgcttctgtgttcttccgcccctcgcaggggagcctgggctccgcgcacaccctctgacatggagctgggggcatcgtgcggtccccaagctctgcccctgagctaca

SEQ ID NO: 93589 - DNA, 432 bp, Homo sapiens
gtattatctgacatgtctttcctgctacctctttgcagtcctggcggtcgtgatttttattgtagatgtatgctgtaaatttatagcaagtcaaaagtgcaaaatttaatattaattacaaagggaaggggaaaggaaaatgctttttgcagcacaatttaatacgagctcctgacaatattaaactttggtgaggaaaggatactcagagcttgatacatttgagaatggtgagattgaaaggaatacaatcataaaatggcttaaggaagtgcttatctcatacagatcataattgctgtatcatgaaaacatacattgttctctcagaggaaaactgtcctttatccataaaggacaaatatttacaaagtactccagtttaatgtgtcctaattagacaaaggctaaaaagctttaaaatattaaatt

SEQ ID NO: 93590 - DNA, 588 bp, Homo sapiens
tttgcttgaacctggaaggcggaggttgcagtgagccaagattgtgccactcaactccagcctgggcaacagagcgagaccccgcctctaaatcaatcaatcaatcataactgctgaaaatgatctaagtgaaccaacggcatggaatacgtgctctttctctgtcctgggacatactgcacagaggactcaatcttagctcagctccttgggccagcatgaccttaaacaagtggctcaatatcttggagcaaccccagttatcatcattaaggtagggacaaccataacaacacaatcactctaacactaactatccaggcaacccgaggccacaagcagaccctcaaaggctgtttgtggtaatgacgacaacatccttgacccacctgctgccctgtcatgacagggagggctgcagcacaagtttattaatagatacctcatcatcttcagcacaaacctaaagcaagttttttcaagcctggtttcacagaatgtcaggttagcattcttcagtctttttttaaagaatactgacttctgggccaggcgcagtggctcacgcctgtaatcccagcactttgg

SEQ ID NO: 93591 - DNA, 596 bp, Homo sapiens
tagatggactcttgctctgtcgcccaggctggagcgcagtggcgcaatctcagctcactcaactccagcctgggcaacagagcgagaccccgcctctaaatcaatcaatcaatcataactgctgaaaatgatctaagtgaaccaacggcatggaatacgtgctctttctctgtcctgggacatactgcacagaggactcaatcttagctcagctccttgggccagcatgaccttaaacaagtggctcaatatcttggagcaaccccagttatcatcattaaggtagggacaaccataacaacacaatcactctaacactaactatccaggcaacccgaggccacaagcagaccctcaaaggctgtttgtggtaatgacgacaacatccttgacccacctgctgccctgtcatgacagggagggctgcagcacaagtttattaatagatacctcatcatcttcagcacaaacctaaagcaagttttttcaagcctggtttcacagaatgtcaggttagcattcttcagtctttttttaaagaatactgacttctgggccaggcgcagtggctcacgcctgtaatcccagcactttgg

SEQ ID NO: 93592 - DNA, 752 bp, Homo sapiens
gtgagtttgaagttcaggggagtgggctggactggaaatgtgaatttgatagttactagcataactgcttagagccgtaagactgaatgagaccaccaatgggataagtggagataaagcagagaaggggtccaagggctgagttgttgaaatccaagaccatcagctataaaatttttgaacttcataagagcaagaattttttctcatggcacggcctgctagatgcttgttcagatttctccccttctttctaagaagatcctgcctggagaggagcaacgacgtggctaatggatgtgaacatgaccaaattacgtgtaggcaaaagtcataggatggaattctaggaaagttagaaagtgtggggagcacaggcagctcagctatcatgcttttcttaacctttgtccttgccctccttcctgcttggaatgcagatagaatgctgaaggtgctggagattacatcagaaagactgaaaatttccaaatttatcttgacattatggagtaaccaaaatagccccaaactgcctgcattggacttcatattttgttagaaaaaaacaaaactcctcattcatttaagctgaggggagcggggtgggggcttacagcaaagtgtattccttaatatacatttatgttgttccctactttatcccctatatctagaaaaatgcccagcatgtgacaattactcaataaatattgattgggtgaataaatgaacatctaagaattccacaa

SEQ ID NO: 93593 - DNA, 693 bp, Homo sapiens
tttctgttccaggattcaatccaggatgccacattgcttttagttgtaatagttctttatttgttttttatctttcatgaccttgacattttttatgagtattggtcagttattttgtagaatgtctctcattttggatttatctgatatgttctcatgattcgattgcaattatgtatttttggcaagaataccacaaacatgatgctgttgtttccttgtctcagtggattgtattcagaggtataggatgtcaattaatcttattaactggtgatgttaaccttgatcacttgattaagatagtgtaccagatttttccattgtaaaattattatttattcatttgggggagatactttattctcttgtgggagatactttgaatctatgccaatttcctgtttcttctcacttttgcccattgattttagccattagtggatcttgcctgatgtaattattgctgtggtgttggtctaatggtgatttttaacttttgtcagtccttctacacttattcattgtaattttttttttttgagatggagtctccctgttgtcacctggactggagtgcaatggcacaatctcggctcactgcaacctctgcctccccagttccagcaattcttctgcctcagcctcccaagtagctgagattacaggcacccaccaccacgcctgactaat

SEQ ID NO: 93594 - DNA, 316 bp, Homo sapiens
gatggatacagggttattttttgggggggcagagggtgttaatgaaaatgttttggaactagacagagatgatgattgcttaacgttgtgaatgtatttaatgatactgaagtgtatggtttcatacagggacttgtatgttatgtgaattttgcctcattaaaaaaatactgctaggagcaatggctcatgcctgtaatcccagcacttgggaggccaaggcgggaggatcacgtgaggctaggagtttgagacctgcctggccaacatggtgaaaccctatctctattaaaactacaaaaattagccaggcatg

SEQ ID NO: 93595 - DNA, 540 bp, Homo sapiens
cacacatttatattatgagtcctgcatataagaagtcccattctctgggaatctcctttctccttccgacttcatgcccagcaggagcttttcagaatacaaggagggggaagaggggagggtcagagctgagcatgagagccactcttctgtgactggaaggaaacttccattcatggacagatgagaaagcctgtgctagaagccaccttgtagaaacatacccaggtttgagtaaacagacacctgcttagcacagtttccatactaatttttgcacatatatgattccaagattatttttattaaacatccgataagtatatatcctttggtataaatccatcaggttttgctggacctaccagaagttttagattccttacccaaacctccaaagtgtaaacctggccgggcgtggtggctcacgcctgtaatcccagcatttttgggaggccaaggcaggcagatcacggggtcaggagatggagaccatcctggctaacaaggtgaaaccccatctctactaaaaaatacaaa

SEQ ID NO: 93596 - DNA, 471 bp, Homo sapiens
ataacttcttaaaaatacatgaattataatgaatggggaggaggataaaataaagaacacccaatcactggattgttaaaacaagagcagaaagtacatagtgatagaaaacaaggcatggcgtgtgcctgggtgaagcttagaggctaacagaagagatgataagtgagcaaacttccaaaggatcactattaaagactccacaggcatcatcacggtgtatggaagttagggggatactgggaaaatactgttttttaaggttaaagttttaaaagaacttccatttcttaagcacctagtagtgccaggaattgcaccaggaattttattccaaacaaaaatctggtaaggtaggagatggtatctcaaccttgcaagtgacaccatgaagactcagacaggtgcagtaagatgtccaaggtcacaccaacagtaagaggcacgaccatgatttaaatctcatgctaa

SEQ ID NO: 93597 - DNA, 328 bp, Homo sapiens
caattcatgtcatacatcataatgctcattataatagacttcttgtcttcatgagataataataattactgagtgaggagctaagcttgagttataactcatccatttacttcctgtattacaattgttaagtctctttaattccttgcatctttgtaaaattgaaaaatactgttgacattttgattacgaattgaagtatattataaagtttggtttatggtttagatcagggttcagttaagctacagtctgtgtgtcaaagctagcccactgtctgtttttgtattgcctacatacaattctgtttcctttttaaattttggga

SEQ ID NO: 93598 - DNA, 469 bp, Homo sapiens
tttttaagacagaattttgctcttgttgctttctgaaagagttgtattgtatgtacatccaccagacatgcatgagtatggccgtttcattgcagatagcacttctccctgctggtttaggtccacacatgcctactaagtgaaggaaaaaattgggatgaaccaaatgaacttcagtaattctgtcagctcacatgttaacgtagcttggctgtctgaggttacatcctggcgctgtgaccgacagcaaatgacctaactgccctggatttcagttttatcccctgcaaagtggggtataagaggaagaataataagtgaatagacttaagtttagatttttgcctggctggcagcgatggagaagagcaaaaccaataaagtcagtttcttaggtagtaatgaaaagattgttctttattattaaaaagtgacttgtttgggaagaagtgatacattctcattataa

SEQ ID NO: 93599 - DNA, 370 bp, Homo sapiens
ataaaagccctggaaaattgctttgtaaaccataaggcactctgcatacaaaagagattactatgaatttttcctaagtgattaactcatgactcctttccatactcctcagcagtggcaacattgggaggctggattttggtgggatggaagataatgaggggactctggtttctggccagctccaggactggatgtgatggttaacgatacttaacatcaccacacagctcattccctagctggctcagtaactatggatctctaagcaatgtcttaacatttacgcttacatctgctaagctaagtatgtactgttccttgatttacatgccacattgatttttttaaggggtttcaactgtggatc

SEQ ID NO: 93600 - DNA, 273 bp, Homo sapiens
aattatttctaaaatttattcagtgtgaattcctttccccccaacacacatataatattcctcagaacatgcaaactgttctaaatgctgctgtaaaaaaaagttactaaagtccaaactgcttttgttggtttgcttctaaagctaggaaaaagagaaaagaatatgtatataggtgaaatcaaataattgggaagaaaaacagaatatctgcaaagcattaaatccaattctatttttttcatgctttctgatatctgtaaaagggagatc

SEQ ID NO: 93601 - DNA, 123 bp, Homo sapiens
actgtcaatactgctgaaatcaatggtaataccttgcatcctcattgtccaacatgattttaataaaactcctttagggccaggtgcagtggctcacgcctgtaatcccagcactttgggagg

SEQ ID NO: 93602 - DNA, 825 bp, Homo sapiens
aattcccttactcagactcttttaagtattggacctcttggatttatcctatgttctttttactgtatgttttggtcattcaatttaatattctgagaaattttgcaggcccaatttaatgtatcttttgaattttttcctgtgccctgaattatgtttgtttcggttgaaatttttccttaagtgtctggtgatccctggatttctgctcataattaaggaaaagaatgctgactcactggacccaggcagggcttctctcccagattgcaggcttgcctcggggatacacgggtttcccaaatgctagaatgaaaagagattttattttggcttgctaacatcaaagatactagtttctccagatggtttattcagaacactgttgtcttatttttatttgtctgagattaaatgtcttcccctttaattaaagggaggtctctgatgaagtaggtttgggaactgctaccttggtgacagcttgagtctttcctttagtgaagtgcagcacaattccacgtgcacggtgaccttctcttgattagggtgccttggaatgtacagaacctaacttgaatatacagcactggtttcttggataagaagtgtacagtgatctaaacttgcaaaccaaaatacagagatgatgggaccaaaaattatcaacaggaatgtccaagaaatatgatcagtgtagccatggatacgtgtcatatttgactctatgtgcttccaaaccaatcgcaaacaggcctgggcaagctgaattactgtctttgaactccatctggttggattagctcttgtactttttaacaactc

SEQ ID NO: 93603 - DNA, 343 bp, Homo sapiens
aaatgaagtgcatcatgtgaagaataaagtaaagtttcctaataaccgaattctccacacatgggaaacacagagggctgtatctgcctccgacacacactgacttggacagcccgccttccacttctcaaaggggaggacgtcggaagctttgtcagtgtttagacgtaaaaagttcctgaaggcacgttactgttctgacctatttaaatgacagtaaaatacacagaacaaaatgcacatttttaccattttctgagtgcacagttctgtggcaccaagtacattcacactgttgtgttgccatcaccaccatccatctccagaactgtctcaccttccc

SEQ ID NO: 93604 - DNA, 478 bp, Homo sapiens
aattcggaacgagggaaaggtccaaagcttaaggaaacagtggccaagttatttgaaaactgagttctgttttctacataggcttggatcttgggaatacgggatagtttgtttttaatcacaggaaccatcttatcagtttctataataactaaaagaacaaatatgagaaggttaaggaacagcttaattaaaatgttggagaaaatgacagaaataaattaattcagagagtgcctttgacattaatcatggaaaaaatgcatctcattttggtagcatacttagaaaaagcaaaataagaataaatttgcatgccaattagatgcaaagataccacacatacctcaagataaatttgagatcctgaaacaagcaattgggtctataatattttgtaacatattcatttggatatgtgcgctatctgcatttttagtgaaagaaaatgcattcaatcaagggccatagagagagt

SEQ ID NO: 93605 - DNA, 374 bp, Homo sapiens
ttttgtatttttagtagagacagggttttaccatgttggtcaggctggtctcgaactcctcaccttgtgatctgccctcctcggcctcccaaagtgctgggattacaggcatgagccaccgcacccagcccctgattcctctttttcctaaaattacttaagcacatgtatattaaacaaatgacttttcatagtggacttactcataaaccagtaattaaagtcttgatgtgtgcagaaatgcaaaacatttcccagtctgatttttggggcctctctcttataagggtttgctttcccataatgtatcgtctgctcagtgtgcttgccacactatctgtggtgacaatgtattgtcattctcttggtctgac

SEQ ID NO: 93606 - DNA, 144 bp, Homo sapiens
aaattagaatgtgtatgtatattttaatttttaaacaattttattgaggtacattttacatataaaatttacttatttcaggctgggcagagacagcagtctctactgaaaatagcaaaaatagcctggtgtggtggtacgtgc

SEQ ID NO: 93607 - DNA, 1006 bp, Homo sapiens
tgagacagagtctcactctgtcacccaggctggagtgcagtggcacaatctcggctcaccacaacctctgcttcccatttcaagcaattctggtgccttagcctcccaaataactgggattataggcgtgcaccaccacacctggctaagttttgtatttttagtagagacaggatttcaacatattagcaagtctagtcttgaactcctgacttcaggtgatctgtccacctcagcctccaaaagtgctgggattacaggcgtgagccaccatgcctggccaggcataagtacattctatgatgttcacacaatgacaaaattgcctaacgacatttcttaaagtgtatccctgttgttaagcgacacagggctacactatcttctcagccactaaagatatataaaagtacgctaatcctaataatctttaatctgagggtactgcttaacaaatctcaaagtttccataaactagccatctcactgctttaaagtaaacaaaatctccatattctgtttcaagtgtctcattaattaatagtggtaaaagcatgagcataaaaagtcacaatttcaatcatttttatcctaaacctaaattttaaaaacttaaatcacaaatactctaaattctaacctctttcaccctagagactcaatgatcttctcccactagtaaatataggtcctaccacccaaatttgattctcactatactgtcaggttctttctttcccactgagactggtcaacccagctggcctggaaaaacagttaagtggagaagtaaaaggattactttcccttctaaactaacccaaattaaagtctattctctatgaagaaacaataattaacctattctgcagctgtagagtatgacagaaagagagggtgagacagaaacagagatctctaagatcttgagaaagaacaaatacacacacattagtaaagtatgccatcatctttatttaaaagcagcatggtcacacatttgctc

SEQ ID NO: 93608 - DNA, 477 bp, Homo sapiens
cattgagtgtcaacttgattggactgaaggatgaagtactgttccttggtgtgtctgtgaggagcatgttgatttggcaaagaacaatttggctttgaagagggagcaccattttgcctgtttctcatgtgtgagcagacggactcagaaggcactggttccaatccagatttgctgttaagcacagcgccctccacaaccatccatgaagtggagcagaagaacttccgcctttcagagcaagcctcctgggattcattgattttgtaattccttgcctctatttgtgttataatacattgaaaccaaagctagcatttcaaaaatcaggaccaagtattttagttactcgggaccaagaacataaagttcctgtgaatgaaattaacataaggacagagccgttcgaccaagaaaaagaaaagtccaggagattaaagatacaattcagatgaactgttacaaggtaactccatg

SEQ ID NO: 93609 - DNA, 381 bp, Homo sapiens
aaaatatgccctcttccagcttaatcaccctctttgttaaagaaagtcaggtcagggagaaaacaggcaagaacttgagcgtcagaattgcacgtccgcgtgtttgtgcggggctggaacttggcagctcccgctgaaattaaagcgcgagtcttgcgccccctcatggccccaggcggcaccccagcatctcccgctctctggacaagcccctcccccgctgattgtatttcacattgggagcccagacagggtggtctcgccgggtggctgtagctgtggatgacgagttggttctaggactgaggcctgagggcagctcagcctggggccccttgagcacgcagtcacagagcccaggattcctcttaaagagcacag

SEQ ID NO: 93610 - DNA, 563 bp, Homo sapiens
gggaagattgcttgagcccaggagttaaagtccagcctagacaacatagagagactctgtctctaagaaatatatgtatatatacacatacctatatatgtatttgtgtgtgtgtgtatgattagggactttctgttaggtttatttcagcatggtttttccaccatgtgtttctttcaaatgcagagctatttctctgtataaaataaacacattatccttcaacagaaatctgaaatgagccgggcatggtgacacctgcctgtaatcccaccactttggaaggctgaggcaggaggatcgcttgaggccaggagttcaagactagcctcggtaacatagggagatgccatctctacaaacaattaaaaaaaattagccgggcctggtggcttgtacctgttgtctcagctacttgggaggctgaggcgagtatccgcactccagtctgggtgacagagcaagaccccacatcaaaaaataagagagaaatctgaaatggacatctgagtttgcagtttgcccagtgcagtgtttctcaaacttgccaaatcatcaaaatc

SEQ ID NO: 93611 - DNA, 527 bp, Homo sapiens
gctattaatattatgtggcaggccatatcaaggcatggagaatacagtggtaaacagaacagatcaaacctctgcccttatgttggtgataaatgctctagcaccttggtaatcaaaatacctccgtattagcagtttatcggaaatgcagaatctcaggccccaccccagatctattggatcagaatatcctttaaacaacatcctcctggagtttcatatgcattttcaagttgagaagaaatagataaaaaaataagtaaaataaggaaaataggaagagtttggggagcttaatgggagattatgtaagagagatatgtggaggtcaaatgcccagggctctgtgggttatttgaaggacgtgggcttttgctctgagtggggtggcaaaactggagaggattttgagacaaggcatggtgtaatgtgactaagtataaattctatgtagcacagccttaaatgttagagaggtagaaaacagatcagtggcggcctggcaacaggggataggccacaaaagg

SEQ ID NO: 93612 - DNA, 675 bp, Homo sapiens
agcacttctaaatgctagtgggaagaccaaaaccatataaaatatatatcatagtcatttaaaaaattagtttctgctatgaggcagacttagcttgataaatttcaaatagcctttctcaatatcagaattttttttcttttgttactggttcagtaacaatcaacaatatcaagcaattagatgaattaatgaaagccacaggatatatgatatctgttaatagagaacattcagaaatgaaaaaaaaatttgccaacttccttctagagcaaaacattcttctggagcacaattctcattcattgaatatccaactgtgaaaccactaaaggaactgcccagcagatcgccttaaagcagcagttctcaaatattttggtcttgggacccttttacactcttttttttttttgagatggagtcttactctgtcgcccaggctggagtgcagtggtgtgatctcagctcactgcaacctctgcttcccgggttcaagtgatttgatcctgcctcagcttcccaagtagctaggattacaagcacgtgccaccacgcccagctaattttttgtatttttagtagagatgcagttttatcgtactagccaggatggtctcgatctcctgaccttgtgatctgcccacctcggtctcccaaagtgctgggattaca

SEQ ID NO: 93613 - DNA, 492 bp, Homo sapiens
atgtcaatgggccagggtggaagtggggaggccaggtaggaggctccacagcctctgagtgaggccagccctcagcctgcacaccagacaccccacactctttcaacaagacccccaccctgtgcagccagcctcatggccatctctggggtaaaacataaaatacccagaggggtgaggacagagctaaagatttcttaagaatctgttagtgctggacatggtggctcacgcctgtaatcccagcactttgggaggccgaggtggacagatcacttgaggccaggagtttgaggccagccttgccaacatggtgaaatcccatctctacaaaaatataaaaaattagccaggcgtgggggtgcacgcctgtaatcccagctactcgggaggctgaggcaggagaatcacttgaacctgggaggtggaggttgcagtgagccaagattgtgccactgcactccagcatgggttacagagcaagactccatc

SEQ ID NO: 93614 - DNA, 419 bp, Homo sapiens
caacattgacattattatgcaaccatcactgtcatccatttccagaatgtcttcaccctcctaaactgaaactctgtccccattcaacactaactccccattcacctccccagcccttgacagtcaccattctacttctgtctcgatgattttgactactctagggacctgataagtgaattcatacaatgaggtgccctttttgcgactggcttatttcacttggcacaatgtcttcaaggttcacccatgttgtagcctgtgagcatgggtcagagttcacttccctttcattgctgaatgaaattccattgtttgtatagatcacattttgtcaatgggcatttgagttgtttctaccttttggtgactgtgaataatgctgctaagaatactagtgtcagccaggcatggtggct

SEQ ID NO: 93615 - DNA, 817 bp, Homo sapiens
caggtgatctacctgccttggcctcccaaaatgctgggattacaggtatgagccactgtgcctggccacaaataatttttataaaggaaagaatacaagcttgctttttagagttttagaattaactcaaaacagaagaagtaagaattaagttgactcttaacagatttttagctatgttagtcaaggtataaaattcggagtgcaaagtgaccttagagttacactagtagctaatttagtaacttggcattttaagctgaatgaaattaagactttgttttaccctgttactttctaatttgcagttttaatttgatcaatttataggtttttataaatatcttaaagaaggtcctttctctaattttataagatcttaaaaataataaatcgttattaatttgtgttgaactttttctccatcttatgattggttttttcctttacagcaaaaagtattttttgggcaaaattgcaaaattgcttttttcaatttattcatgtgatatgttacattaatagcttgtctatattaatatttaacaatttggtcatgattttaaaagtacatagttaaatttgttgttaaaatatcttatgatttttctttcttaagattgtatcatcttcatatataaactgactagattttcctgttgtatttttattcctgggaacatgttgcataaaatagaaattgtctcttccttaaaggttttgtttaatgtgtctataaaattgtatggaaagttcctggtatgtgttttttgggaaaatttgttttctgtctttttttgtggtaaaatacacataa

SEQ ID NO: 93616 - DNA, 427 bp, Homo sapiens
gtcctgggcaggccacaggcctgaagcaggaacaggttggagcagggaagacccctcaggacattccccatgtttgtggccttctgtctgggagagggggatgggatcaggggtcacactgtggtgactggatctgccattcacttagtcacctgttgtgtgatgccaggcaggtgacgtccttccttgggcatctcctctataaagggcttgtgttctcctggggtttgcaggcttctttaagaatctcttcctccctcattaatcctacaggtcccaactgagcctgttctcatgccaggagctcctggcacactcctttcatcacctgccggagctgggctctattatcatccctatttgacagaagagcacaccaaggcccagaggctactgctgcctggcggtcagccttctcctcaccagt

SEQ ID NO: 93617 - DNA, 375 bp, Homo sapiens
actcgctgattacagtttatactatggacgccaactgatgacaatctgtaccatggattacctggttctgaatgctctgtcctttgtctgctatgtaggccattcacttaccaaccttccccttaccctctgttttccagacttaatatccttccctataatttttcactgcctctggaactcacaaagttgttttccttctttgcatagagactatcctttccttaactgctcccttcctgagttcatccctattcatcacagagatgtcatgcataaacgtgctgtacctttcccaggaaaggagttcttcatcaccgaaacaaattcatatcctgtgttttgtcttcttagaataactgttctctacttttt

SEQ ID NO: 93618 - DNA, 392 bp, Homo sapiens
aatacattgcgccatgatggctacgacataggaatttttcagctccattataattttatgggatcaccgttgtgaatgcagtgcattgttaaccaaaatgtcattatgtgttatatgactgtatatataatctcgacttttatttgtaccaatatatacaatgggaaaagttgtaccatgcaaataccagttagaaaaaaaaactattgtaatgatattaataacataatacaaagtatattttagagcaaagaatattaccaaagatgaagtttcatagagataaaatagtcaaggcatgaagaggacataaaaaattataattatttgaaataaaagcataagaaggaggtcttaagacacttatgtgccctttagtaaaatgattataa

SEQ ID NO: 93619 - DNA, 767 bp, Homo sapiens
ggggagtgggtgccagtgtgcccctgtcctgagagctgagcttcagggccaacagggcaagtggctcaggacccactcaaggtgcctgtggtgggaggacagcccagccctccaaggtgaactgaaaaaacacatgccagtgagttttaaagctgaaggctggaaagctcttctccattgcacggctctgatataccggcttggctttcacaggaaaatcagctgtgcgtggggtgtcctctgagattctcctaattgctttgcaggtctaaacataccgcacaatgctgtcagggattgctatggatagccaactccattctgctaaacaaaaccagtaatttggaaaaattacagccctggatgccatcgttggcaccacaaggacgacctccctgctaactgttaaaaaaagaaaaaaaaaaaattggcggcacaccaggccaaggaaggcctctgtgtaagtgtggaatacgacaatcctttaggaaaaaaagcaaaatagaaaactgaatgaatttttgatgatttaacctaggacagtggggtcttagagggctgtggctgtttcatttggaatagttattttgtaacaaaaagggcatatcctgcttcccagccttaaccatatgcaagcactgtttagcaacttgctcctaatgacaccttcctctgaaaagctagttcgccatgaaacagatatttatgaggcctgtggttcatcttcctagagattcccataaacacaggtgtgtggacacatctga

SEQ ID NO: 93620 - DNA, 473 bp, Homo sapiens
tatttgtacctttgccatttttattccccagcagataaaacaaatgaccttcaagtttgtactctcagcgttactcaagactcagtggttaaacatttcctcctctcaagctctttcacaggtcagcttagtcaggtcactgttcttttgataatttagtgatgagagaactattagattttcagtttcctgttctacaagtgagtttgaacataaatggtgttggacagtggttttgaaatctggctggtcccagaatcacctgaagcttttctttcctcaaacatttccaaaccttaccccaggagattctggtgcaatgagatggttaaatgtggtagacttagcatatgcagtgataatactgcaatctttcctacatccccactaaaataaataaaaatgatattcattttaacccacaaggacagatgagagaggagaccatagcagatgaaatagcgaaagctgca

SEQ ID NO: 93621 - DNA, 278 bp, Homo sapiens
ttcaaccagcagcaatctcctgcaggagagtgaagttggaatattggtttccctggctgactccctgttggtttttggctaaaggctgcagatcctctcagaggcccttgctgcaggtccgagtcccctgactttgagtagttactccctccccttccttttcttcaagcttaggaggagtaaccatttcccgccattgctaattctagggatccacatcatattccttaccccctcattaaactttcctcaatatcttttttcttgccagtatcatg

SEQ ID NO: 93622 - DNA, 224 bp, Homo sapiens
tgctctttcagccatttctttttatttacagtttgtgttcaatgcaaatcaattccataagaagttactatgaatcaaagcgtaaatacacaaacacaatatacaatccaaaatagatgtacagcattctggaataaagcaaaagagtgttcattcacacacacagtagcttcaaaactgttcgatctgtttgttctcatgtagttttgtaaagatggaaaaaa

SEQ ID NO: 93623 - DNA, 1014 bp, Homo sapiens
cgcgtgccctactggcggtggagaggctgggcgggccccataggatgcccgctttggagccacaggacctcaaaatacgctccttacaacgtgttttatagagcgaagtctcgctatgccacccaggctggagtgcagtggcgccatcgtagctcaccgcagcctcgaacacctgggctcaagcgatcctcccgcctcaacctcccgagtagctgggaccacaggtgcgcgccaccaagccgggctctaacagtttttaaccagacctgttgatggtttctggggcgagcactagctggggatttttatatcagctggattagttttttccccctaaacgagtctacaaaatcccggacatttccagggtcctgagacggttccctaccttccttctgcgcagagattgcctgttggggatgaatcgcttagcgagacccagccatagctggctacgctgagttccggcccgggaccgcgcggagaggcaagatctattcccgaccctctcatctggcagacagaacccaggcttcaggaagagaagcggctttcgcagtttcacgctaggacgggctgagctgggaatcgatcccaaattccacagtcccagtcctctcctgggtcctgctctcctgactgcgtctcaggcccagaggtgatggggcacttagggttagggaatggcagacctggagaaaagggttccgctactaccctcggctttgccaaacttaacattttgaaattccattccacaaatgtgtactgcgtctctgggaacaagacagcgtaatgagcatcgtgagaaatctaagacgaatccctaaaccggcgctgtctttaaagagattacaaccatgctataattacatacagagctgtatctctaataaggacccaaccacggttttatctggctagtttttttgtttgttttgagctctggttatttcccatagccaggaaaatcaaaatattaaaaacaagggataggggaaggccagaagaaaa

SEQ ID NO: 93624 - DNA, 961 bp, Homo sapiens
cgcgtgccctactggcggtggagaggctgggcgggccccataggatgcccgctttggagccacaggacctcaaaatacgctccttacaacgtgttttatagagcgaagtctcgctatgccacccaggctggagtgcagtggcgccatcgtagctcaccgcagcctcgaacacctgggctcaagcgatcctcccgcctcaacctcccgagtagctgggaccacaggtgcgcgccaccaagccgggctctaacagtttttaaccagacctgttgatggtttctggggcgagcactagctggggatttttatatcagctggattagttttttccccctaaacgagtctacaaaatcccggacatttccagggtcctgagacggttccctaccttccttctgcgcagagattgcctgttggggatgaatcgcttagcgagacccagccatagctggcctctcatctggcagacagaacccaggcttcaggaagagaagcggctttcgcagtttcacgctaggacgggctgagctgggaatcgatcccaaattccacagtcccagtcctctcctgggtcctgctctcctgactgcgtctcaggcccagaggtgatggggcacttagggttagggaatggcagacctggagaaaagggttccgctactaccctcggctttgccaaacttaacattttgaaattccattccacaaatgtgtactgcgtctctgggaacaagacagcgtaatgagcatcgtgagaaatctaagacgaatccctaaaccggcgctgtctttaaagagattacaaccatgctataattacatacagagctgtatctctaataaggacccaaccacggttttatctggctagtttttttgtttgttttgagctctggttatttcccatagccaggaaaatcaaaatattaaaaacaagggataggggaaggccagaagaaaa

SEQ ID NO: 93625 - DNA, 1365 bp, Homo sapiens
aatcaaaggtgggaggattttccctaaactgacttagcaggactcttgttacaattggactaggcaggctgaagacaggatgcaaggacaaagcttgttgaaaagaggcctcagaggagctcatctaaaatttggtcaaggggagggtctttcttggtccctcctcttgttcaagggaaaaagagacattcttctttcctttgaacaatataagtcaatttctcatttggtggcctttttttcattaaggacaagctgagccccctgctgaaacttggtagcagggcagccagttgagaagatttctagatgtcaaggcatctttagatgatggggtgaggactgcagtggccatcccagatcatggattttctggtttgcagtttgaatgtccttggtgatggcatagacatcagtgtcacagtcatggttatttttccgagcagagtgtagaagtgtccaacttcatcttgaagggcttctttaggcagtcacaataaagatctgggaagttaggttttagttctcagtgatgccaaatcaggacagtgggagaaaaattaaaaacctcagtttggagagtggtagccagatagtaaagggaactagaagaactgagaatttggtaaggactgacaagctgtgcatgatgacaggatcccgttcaatttacaagtagataacaaaacctgaaagacaagtacaggaccagaataataacccataagaaggtgctatagtttttataaaatatctttctacagtcatcccccttttttgatccaaattaaccaaagtaagattattcttgtttacaaaataagtcttgtctcattatatttgacttacttatttgcataattgcagcaagaatggcaactgaccaggtaggcttatttaagtttgcattgctggaactttttacaagtaatctcagattatgctttcaagagttcttgaagctataaagccaagtcaagcaccaccaggccttatctgcaatgcctagagattcagatgggttcttctcttcttgaggtcctaaaaacatcctgagtttctttggcctgccagaaagtcaccttcctgactcacctgtaaggctgggaactccataatccaggtaccaggcagactttccgggagggcttcatatgcattggctccataaagttaaccttagttcctcaaaactgtctgttcatatgtgattttatgtcttattctcagttggaaatgcagaaatcacctgtcttctgcgtcgatcaggctgggagctgcagaccggagctgttcctattcggccatcttggaatggacccccatgtcttattctcaaataaaacattttggtcaaagccttga

SEQ ID NO: 93626 - DNA, 473 bp, Homo sapiens
attgcaaggcagatggacacagcagcagcacataagagcacacgcgtggggctccagcccggccacggggagaccttttctcagcaaagggcagcactgctcgctttgctggggcagccctcccaggaagatcccagaagagatggtctgaggccctgaaagcagcagatctcacctgcattggaggatgagacgccacatgaagaagaaagaagacgccacagacagcagcgcagtaccaccttccagagatgtcctaaaaacatcctgagtttctttggcctgccagaaagtcaccttcctgactcacctgtaaggctgggaactccataatccagttggaaatgcagaaatcacctgtcttctgcgtcgatcaggctgggagctgcagaccggagctgttcctattcggccatcttggaatggacccccatgtcttattctcaaataaaacattttggtcaaagccttga

SEQ ID NO: 93627 - DNA, 1127 bp, Homo sapiens
ctgttcttgaactcctgaccttaagtgatctgcctgctttggcctcccaatgtgctgggattacaggcttgaaccactgagcctggcctactcctttgctatcttaataaacttggtttcagcttactttatggactcgccctaaattctttcttgtgcaaggtccaagaaccttctcttggggtctgcatcaggacccctttctgccctttctggtaacagtaccataataacaaatattatcgagcatattttcatgtaattatttgcaacttgtatatcttctttggtagagtgtctgttagaatattttgtctatctaaaaattgggtttgttttcttattattgaattttgagagtgtgttatatgttctggacacaagccctttatcagagatatggtttgcaaatatttcttctagtctgtgacttttctctcttaacaatgtcttttgaagagcaggtgttttaaattttgatgaagtcagatgtatcaatttatgattttaataaatcatgcttttagcatagtatttaagatacttaacccaaggtcacaagagttttcttttagaagttttagttttaggttttgcatttaggtatatgatccattttgagttagtttatatacattgtgcaaggtaaggactgaggtttttactttttgcatatagattaccacttgtgccaacctcactgttgtgatgatatgatagaaatcactgtcttttctccactgacttgcttttgcatctttgtaaaaagttggtcatgccaatgaaactgacccaattttcccatagaactgatgggaaaattgaagtggactctccaggttttaaagcttgagaaacttacatttgtcttatctgagtttatttctcaggaaaccagctgtcaggcctcccagatagtatcagaaagctgaagatttccagatcactgcatcctaacagcaaggtgccagaaccctgattcaactacctactgcctgttgagcaactcctacataaactcctaactttattggttacagagacagattttagacttgtctcccatatcctggctggcatcaccagcaataaagcctttcttcctggcagtacttgttgtctcagtg

SEQ ID NO: 93628 - DNA, 550 bp, Homo sapiens
attgcaaggcagatggacacagcagcagcacataagagcacacgcgtggggctccagcccggccacggggagaccttttctcagcaaagggcagcactgctcgctttgctggggcagccctcccaggaagatcccagaagagatggtctgaggtgtgtgaacactgtgaatgtcatggacaaagctcagcgtgggaccccatgggacttcaggccctgaaagcagcagatctcacctgcattggaggatgagacgccacatgaagaagaaagaagacgccacagacagcagcgcagtaccaccttccagagatgaaaccagctgtcaggcctcccagatagtatcagaaagctgaagatttccagatcactgcatcctaacagcaaggtgccagaaccctgattcaactacctactgcctgttgagcaactcctacataaactcctaactttattggttacagagacagattttagacttgtctcccatatcctggctggcatcaccagcaataaagcctttcttcctggcagtacttgttgtctcagtg

SEQ ID NO: 93629 - DNA, 211 bp, Homo sapiens
  misc_feature (156)..(156): n is a, c, g, or t
  misc_feature (205)..(205): n is a, c, g, or t
  misc_feature (207)..(209): n is a, c, g, or t
  misc_feature (211)..(211): n is a, c, g, or t
atcctagtaggttgtaagcatccaagaaataatcatttcctcttagtttttttacttgttagcatatatttgttcatagtaatttctactgattgccacttctacagtatcagtgtaatgtctcctttttcattttttattttatttattagagtnttctttcttttttcttagtctagataatggtttgccaattgtatttatntnnncn

SEQ ID NO: 93630 - DNA, 779 bp, Homo sapiens
taagccagtttactaatttattaaatttatttataagaaatacaattgtcaaagcagcagctctcacccaaaagaacagcccattatctccctggagcagacttagattgaaacttaaaaactgttttgatccaaacattgcttactaaaatgccaagaaatcaaaatagtaattaatggatagtaactaatgtagccattgattaccatgtaactctgggtcactattcattagtaaaacgagattgaggacttcaaaaatgagtgaagattgctaagggtaccttaagaatagggttgtcttccctattctactgtcgaaatatgggcgaaatgggcgattatacacaaaaatacattctcagctggaacgctataatgtatcatcacaataaggaaaagtaaaaaataattaaatagaaaaacatggccgtgtttcataacatactcaagacagaaaagagcaaaactcaccaagtgtttaaattatgagttatttcaactgttacaaaaatagaaaacagatatacaattctttaaactgggtcagaatacaggaagatgttaagaatgagatcagcccccaaactgagggcaaagtggtgggcgtggatcaaccaaacgaaaataaactcgacttaacgtaggagcagtttcactctactgtactttgagatatccagaatatttaaagagaggagaaccaggactcttcccctggcccccagtggtctttcatcatagaaaatctgttgagaagaggcaagaggaggtgtgtg

SEQ ID NO: 93631 - DNA, 414 bp, Homo sapiens
accatgagagtgacctcaggtggccctcactgctacactcccaccagcgctctgacagtttacaaatgccatggcaacattgggaagttaccctatatggtctaaaaaggggaggcattaataatccacaccttgtttagcatatcattaagaaaaccataaaaatgggcaaccagcagccctctgggctgctctaaggagtagccattctttattcctttactttcttaataaacttgctttcactttactctgtggactcaccctgaattctttcttgcacaagatccaagaactcttggggtctggattggtaccccttttctgtaacatcttcatgccagctataacgtgaataacacaatgcaagacagtggataagcaaactgtgattatcttcaaataatatcagct

SEQ ID NO: 93632 - DNA, 391 bp, Homo sapiens
tgaacctggtggagcttgcagtgagccgagatcgcgccactgcactccagcctgggcgacagagtaaaactctgtctcaaaaaaaaagaaaaaaaaaaaaaaagaaaatacatacatgtctcatctaaaacatggttggtcaacaactttctgatttcctgatacacattttattaaccggctccttaaatatatccatgttgcatatcatgtttgacatgctttcattgtagcttatagaataatttcaaatagaattttgggataaaaattatgctaccttaaaataggttatgaagtatttgaggtattctctttttatatgataggtaaacttggcttggaattaaaaagattttgaaagttgcttagggagctccctgcttttgtg

SEQ ID NO: 93633 - DNA, 1126 bp, Homo sapiens
gctttctggagagcagatggtggggatgggggagggggagcagggggcaggacaggcggtgaacaggagggagtctgaaagttttcagagatgagacatttgcgtttctcagctcccatggcttcttgcctgaaattgtttccctccataggagatttgagtaaccgatcccttgacaaacaacttaagacagctggagctctaatcatcaaggatttttatggtgctgcttttgaagtaaaaatagtgaaaccccttatggcatttcaagtggaaaaataaataagactggctgtccaaccagccggatgtaaggtgatggctggaagtgccgagagtggtgtggttccatgttgtaggtatgcacgtgctcccatggccatgacctttgagacagtgtaggctagtttgtcaggtcctgtgctgagtattcacctctgaatctccttcttctagaaagcatggtaggaatactgcctgtccaaggcacagggctgtcgtgaaggttttattgagtcacagtcgtgaagggctttggtaatttcatagaagatcacctgttctacctaggctttaaatttgttgctataaaattgagtatggttttctcctgttcacttaagtctccccattgtcactttattccttttttcattcaaaacttgccaaagatttgtctattttagaggtattttcaaagaaccaaacttttatcgatcatatctgctgggtaattttcttacctgattcttttatgcttttatctctgaattcttcttttctgtgtttctggatagatttcgtggttctgcaaagtcttgacaagctgaggagtcatacctggaaaggatggtttgttcaacaaacattgagaccctgtactaggcttgctggggatttcaggggcaagactcagacctgactcttcaggagctcatgattgtagcctagtgggaagacttaacaaaatagacaattgcaaattccaaaaacaaaacaaacaaaaaaaaggcttttgtgtccctactctcctgtggcgacacctggatgataaatgaagccaagattattgcttattttgctctccctcggaaagcagctttctgttttaggtcaagcccgctta

SEQ ID NO: 93634 - DNA, 477 bp, Homo sapiens
tctccacactggttcatggagaagacaaaggagcaaggtccgaaagctctgaagaacgttagagctgagaatcatgaatatgattacttggctgcacaaagtaagaatatgagaaaaaaacaggggagttgagggagaaataggagaaaatataaaggcattaatttcttcatttcctttaagaagagttgatgggtattatgtttggcaaaatgtgatgaaatgtttaaactgcgaaataagtacaagggtgttccttatgcgattagccattttattaagtatttaaaacacaaattattttaaagaattacatctgcaagtgacaaagcaagacaagaggcaagtaccaaagtgtgtaacaacctgtgtttttttttaaagtggagcctactgacagcaacgtgacaaaaccactctcttgtttgctttctcctggactatcctgaatggggaagagaggggtggaattacaag

SEQ ID NO: 93635 - DNA, 393 bp, Homo sapiens
attgtttgaaaaattcaaaattatgatgtatgtcattgatcaccatttgtaatttctaatcaagtgaaatattctgtgggatagataattgcggatgcactttttgtgagttaatgatatgttctcataatgaaacaggatcatgaggctaggttgatgtgatgtcatatttctctgcagtctacagtatgcttccacgtttactgtcatatctcctattagcaacattttgttcctctacaggtaatatacaaaaatatctcctacctatgaaaatttaaattttagctcaactgtttcatgtttattataaaagaaaataaaaaataagtaaatacatacaaagcagtaaaacaataacaaatacccccaaattaaagaagttcaacctgc

SEQ ID NO: 93636 - DNA, 477 bp, Homo sapiens
ttcagttacttttttttggagtgattgatgttccagtattcttctaaacaaccacgggtacaaatgtgaataagataggaccgttgcagtccaagagcttgttctgtagtcctttcctttatatgattttttcccctgatttagaagtctataaagcaaagctaagtattacacactgataatggctgaataaatcaagagcaagagataggatactttgcaaatatgcatatttattaaaaatgtactttaaaatagagattaaaattctcgtattgaatgtagaataggtaagcatttatttgtgaaatactcgaatgcttcatgtaaatactttctgagtttgtatttttagaaaggaacattttggaggctgaggcaggagaatggcgtgaacgtgggaggcggagcttgcagtgagctgagattgtgccactgcactccagcctgcgcgacagagcaagattctgtctcaat

SEQ ID NO: 93637 - DNA, 212 bp, Homo sapiens
accataaaaaaaaaaaaaaagtctctgtcctttactttattttcattgagccccggtgaagctgtatgaagtccatactgctgtcaccctattttacagatggagaacctaagaccagaggtgcaggagcttcttgttgagtttaacgccgtcttgcagaatggatatcctagaatcctggacctgagtttgggtcctggctcagccactga

SEQ ID NO: 93638 - DNA, 180 bp, Homo sapiens
gtccagtctctctgggcctgcactgtccagccgccctcttatccctaagccaaggctttcaccagctaaagctcaggagtaaagtggccatcactgaggccattctatgtatgcatgtatgcatgtatgcatgtatgtatgtatgtatgtatgtatgtatttagagatgaagtcttgctc

SEQ ID NO: 93639 - DNA, 415 bp, Homo sapiens
tggctcttcaccggaggaaatgtgagccggatccaaagggtcgaggggactggggtgcccccgtgacgtctaagagcaaatagaagagggcggcctccaggctaaagctagggcactggggagccccggagaagcctgcctttcctagtctgtggctcagtccctgcttccggcttccggcgcgcagcagcgggagagcgacgctggccccctggcgatcctggcgctgcgaccgcggtggtagcgcgaatgggaggtggagcggagccactgcgccgagggacgcttcaaaaactctttgagtttcagcccttcgcggatccgaggatgtgacagttgttcgagttaaagggtcttaaggcgatcggttgatccaaaagcagctgaatctttagaagacccacgcaggaggatt

SEQ ID NO: 93640 - DNA, 1753 bp, Homo sapiens
tagtgatatggacagtgaagtccaggctgagttggtctcagatgggagatgagaatcttattccgaactggagtgaaggtcactcttggctgtgctttagcaaagagagtggtggcattgtgcccctgctctagagatctgtgaactctgaactcgagagggtatctggcagaaaaaatttctaagcagcaaagtgttcaagatgtggcctgattgcttctaaaagcctatgctcatttgcatgaacaaagtggaacttatatttaaaacagaagctgagcttttataaaagtttggagaatttgcagcccaaccatgtggtgaaaaagaaaaatccattttctggggaggaattcaaggctgcagaaatttgcataagaagagcctcatgttaacagccaagagagtgaggaaaatgcctctagagcatttcagagaccttcacagcagctcctcccatcacaggcatggaagcccaggaggaagaaatgcttttgtgggccagcccagggccccactgttctgtgcagccttgggacatggtgccctgcatcccagccactccagctccagctgtgactaaaaggggccaaggtacagcttgggctgctgcttcagagggtgcaagccccaagccttggtggcttccatgtggtgttaggcaggtgtgcagaagagttgaggtttaggaacctctacctagatttcagaggatgtatggaaatgcccggatgtccaggcagaagtttgctgcagaggcagagccctcatagataacctctgcgagggcagtgtggaggggaaatgtggggttggagcccacacagagtccccactggggcactgcctagtggagctatgagaagagggccaccatccaccagaccccagaattgtagatccactgacagcttgcactatgcacctgtaaaagttgcaggcagttaatgctagcctgtgaaagcagctgtggggactatatgcagagccacagaggcagagctgcccagagccttgggagcccactccttgtgtcagtgtggcctggatgtgagacgtggagtcaaagatcattttggaggtttgagatttaatgactgccctcctggattttggacttgcatggggcccatagcccctttgttttggctgatttctcctatttggaatgggagcatttacccaatgcctgtatccccattgtatcttggaaataactgacttgtttttgattttacaggctcacaggaggaagggacttggctggtctcagatgagacttgacttggacatttgagttaatgctggaatgagttaagactttagggggctattgggaaggcatgattgtgttttgaaatgtgaggacatgagatttgggaggggccagggtggaatgatatggtttggctgtgtccccccacccaaatctcatgttgaattgtgatcctgagtcttggaggtagagcctggtgggaggtgattggatcatgggggcagatttcccccttgctgttctcatgacagtgagttctcatgagatctggttaagtgtgtagcacttccccctttgcttgctctctccctctgccatgtgaagaaggtgcttgctttcccttcgcccttctgccatgactgtaagtttcttgaggcctcgcagccatgcttcctgtacagcctgcagaactgtgagttaattaaacctcttttcttcataaaatatccagtctcaggtagttctttatagcagcgt

SEQ ID NO: 93641 - DNA, 149 bp, Homo sapiens
tgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgag

SEQ ID NO: 93642 - DNA, 401 bp, Homo sapiens
ccaggaccgggtttgggaaggagaaggacattgtctgccaggaccgagagcaggatgggcatcccaggcctggggcaggtggttgcagctgcaggggggctgctgagagcgggcaggttgatttctgaattcctggtgggcatgggagtcaggtagggacacacggtgtatgtcctggggtcgggggacagcaggtcctggattaccctggccttgacgggcggggccccaccagcacctgttctgcaggatctctgcagaactttctgctcctgatgacaggaaatagcgattccaatttagcctcggctttccctgagccggttacactgagatgcgaggctcttgcttcagcaataaaggggacaatacaaaatagcattctttcaaaaataggaccc

SEQ ID NO: 93643 - DNA, 518 bp, Homo sapiens
aactcagagttggctgggccacatgagttgctttggccaattaagtgtgagcagaagggttgtgtcgcttctgagcataaacattaagatcaagtgtgtgattcaccattttctcttcttttatctgtcacttgggccagcagtgttctaggcagagaccaatcccatcagccccagtcctggagtgaaggagacaggagagagctgtagctgacctgtatcagacatttttcatgagcaagaaaaaaacatctgctgttgtaaactggtgagatttgggagtcatttgttactgggctggtcctgactgatacaatcacccacccttgaaatactctgatttcatctatactctagggaatatggatgagacacaccagagcatttccttctccatggaactcttctcaggagggaggaatggagacacctaatattagttctcccctgataccttaaatcatttctgagactggaaagggcctaactaaatgaaattgaattaaaataaatggatt

SEQ ID NO: 93644 - DNA, 379 bp, Homo sapiens
aacccaggaggcggaggttgcagtgagccaagattgcaccatccccccccagcctgggcaacatgagtgaaactctgtctaaacaaacaaacaaacaaactgagtgttatggattgctggagcccaggagttcaaggtccagtgagctatcatcgtgccattcactgtactgcagcctgggcaacagagcaagaccctgtctctttaaaaaaaaaacaaaaaacaaaaaactatgttgcccaggctggaatgtagtagctattcacagtattcacaggcacaatcatggcatgctacaggctggaactcctaggctcaaatgatcctcctcttcagactcccaaatagtcggaactacaagccctcattagcatgcctg

SEQ ID NO: 93645 - DNA, 354 bp, Homo sapiens
cagtgagacagtacagtgagatagtcacattcacacattgctaccagcagtgcaaattggtaaaaatttgctggagagcaatataaaaatagcattaaaatcaagacattttaaagtctatacttttgagcctagtaattccaattctagaaaattataatagaaatagcaatttactggccaggcatggtggttcacacctgtaatcccagcactttgggaggccgaggcaggcaaatcacttgaggtcaggagttcgagataagcctggccaacatggtgaaaccctatctctactaaaaatacaaaaagttagctgggcatggtagtgggtacctgtaataccagctactc

SEQ ID NO: 93646 - DNA, 105 bp, Homo sapiens
aaacaaacagctttatttgaaagacggaggacagccgagtccccccgaccccgtggtcctggcgacatcggtctcacgtgtgggaagaccagtgtcctgtggaga

SEQ ID NO: 93647 - DNA, 259 bp, Homo sapiens
gttgtagtttttccatctgtttttaatctttatttcctgtctttgggtttattttgcatgcttacaaaacttcctgggtgattgtgtgggatggcctggacggaagggaccagggcttcaggaggaggatgagccccaccctttctgtggtgggaatgcctgagctctgttgggctgcacatggctcctactttggcagtcattcaacaagcctgaggaatgtggcttactggtaaaatagaaaagtatgttgccagag

SEQ ID NO: 93648 - DNA, 403 bp, Homo sapiens
caaaaccaaaaccaatgtgaaattgtactcagggatgcaaatgtagcccagtgaagcatttgcccacttgtttggtattattgaagcacaattagaaaaatgtgcaatgtatgcccaaaaattctataataagggccaggcgcggtggctcacacctgtaatctcagcattttgggaggccaaggtgggcaaatcatgaggtcaggagatcgagaccatcctagctaacaccatgaaacccagtctttactaaaaatacaaaaaattggcccagacgtggtggcgggatcctgtagtcccagctactcgggaggctgaggcaggagaatggcatgaacccaggaggcagagtttgcactgagcctactctccagcctgaacgacagagcgagaccccatctca

SEQ ID NO: 93649 - DNA, 511 bp, Homo sapiens
gggacgtcgtctacaacgcagcgatcggagactgctccaacctctgcctttagcccgtttcaaagtcacttccacattttcaggtatccttatagtagcgccccattctgagataccaatttactgtattagtccattctcacactgctatgaagaaatacccaagattgggtaatttataaagcaaagagatttaaatttgctggggaggcctcaggaaacttacaatcatgacataaggcacctcttcactgggcagcaggagagagaatgagtgccagcaggggaaatgccagatgcttaaaaaaccatcagatcttgtgaaaactcacaatcgtgagaagagcatgggggaactgcgcccatgattcagttacctcccactgggtccctcccacgacatgtgggaattatgggaactacagttcaagatgagattcatattactatgtctagttgttattgctaatgaaataaaaaactaatgaaaacaatactggccaggcgccat

SEQ ID NO: 93650 - DNA, 399 bp, Homo sapiens
  misc_feature (239)..(239): n is a, c, g, or t
  misc_feature (362)..(363): n is a, c, g, or t
  misc_feature (393)..(394): n is a, c, g, or t
gcctgtaatcccagcactttgggaggctgaggtgggtggatcacgaggtcagcagttcaacaccagcctggccaagatggtaaaacccagtctctactaaaaatacaaaaatgaaccggacatggtgacagttgcctgtaatcccagctactctggaggctgaggcagagaattgcttgaacccaggaagcggaggttgcagtgagctgagattgcatcgctgcactctagcctgggtnacagagtgagactctgtctcaaaaaaaaaaaaaaagagagaatgcagatgtgaacacatgcatacttggtgacctgaaactgcaggcctgcatcaccactgttggagaccttgtacccttgcnngtgggatgcccgccttgtgccttccccccnnccccc

SEQ ID NO: 93651 - DNA, 371 bp, Homo sapiens
gaagctgagtcaatcagggacttcaaagctctttgagtcccataccctgcctcccaacccaccctagcagggtgatatccccttgcgatatcaagagcaggtggtactttctctattttacagtgaggaaaatgcaagcccagctatacacagtgagtaacagcagccaggactagcacctgtctcctgatgcccagcctgcttctctatcacagcatcgtcccagcctgaggttggcaggtagttggcactaacgtgtgtttgttgactgactagctgactggccagttctggggctttgtggtgaggagggccatggctcgcatggaaggcagaggcctggctcaggaaaggctcactggtttaggcgc

SEQ ID NO: 93652 - DNA, 269 bp, Homo sapiens
cacatcctcaccaacagttactatctgtgtttttcattatagccatccaagtgggttgaagcaatatctcattgtgattttaatttccatttccctgatgactaatagtgttgaacatcttttcatgtgtttattggccatttgtaaatctttggagaaatatatattcagatattttgctcatttttaattaggttgtcttttttattattgagctataataatgtttttcatgttctggataaaagtcccttatcaaatatataatt

SEQ ID NO: 93653 - DNA, 514 bp, Homo sapiens
tcatggagaggttgggctgagagaagctttaaaaaagtgatagcaatcgtaacattttaactgatgacattgctctagtagaaagcaagaaacatggtttagagacgagtgagaattacagcagtgatgccttgagtaaaacagaatggattctgacccacaaatgaagaaattggctttaggcaggagcagacagggaggtagaagaagagagtgcagatgtctgcaggtgtgtcccttgggggaagaattctgcagagctcatctgattgcttcatttttcttagtgaaacagagagcaaggccatcagctgagagtaaaggtggatgaagcagtatttggagtttcaggagaaagaaagtacaacacagtgaaaattttattttcaacgtaatattttatttctaaaatagtgaaagatctggcagataaagggcccatttgtgattcatggttatgagctgtaaagtaaaatatttcaacatgattacatgtttgtttgttggtttattt

SEQ ID NO: 93654 - DNA, 651 bp, Homo sapiens
ttttgaattggtgaaaggatgcaggttagtcacgggttaagctcattaagtcagccttgcagatacaagtggtggcttaattatcctggagcagagctcattgcctgagagcactttaaaagagtctccgcttttcctttatcctagagggcaagcaagctggctggttactaactatattgtcaaaagctgtcctagactcactcctaagttgctgctgattaactgttcagtctaatatctggactctaatagaaggcagcacttttggtttggtaggagacaaattggaaggctgggcatcaagtaagttaaagtcgtccatttatcaaacacaatgcataagagacacagaggctcccgtttccatggacgagacacgcagctgaaagagatgagctgtggacacttagaccttgtattgagatgaattggcaggccaagaggaaaagaagaaagtggttgggaaatattttttggaactggtgaggcattcctgcaagggaaatcaatctaaaactaaacattctttccacaatgtgtgtatgaaatacacttactttattttatagagatgcggtcttgctatattgcccaggctggtctcaaacccctggcctcaagcaatcctcccacctaggcctcccaaag

SEQ ID NO: 93655 - DNA, 426 bp, Homo sapiens
cttttctgaggctcattcaggtctggtcccaccctggagtttctcctcacagaactcataagaggagaccagagatttgggaggtggcttctgctgcctctccagagcttatgctcacaatattctgaaacccaaaagcagataaattagagcaataagctatatattttgaggtcttaacttctttctttttaattaaaaccagtgcttgtagagacattccatcccagtagttactccacaagtcacaagaaagtaaaagaaacacaataaaaaatccctttaaactgcacttaaccctttcctttctgtatccctcccatctgtctacatttatcacttatgctatacatttttaaaaaaaatcagtgagaggccgggctatgtggctcatgcctgtaatactagcattttgggaggccaagg

SEQ ID NO: 93656 - DNA, 509 bp, Homo sapiens
ccggggcggggatgcgggcgccggcgagctcgggctgcggggtaccgggcgtccgcggaggggacgcgagccaggctcccagagcgcagccctgagcccggcatccacacggacgggcggcccttttgtccttactcgccgaactcgaattacagcaaggtgtcagggagcgctaattgtttgtgcttgtcaccatgcactcggaggcaaccccgaatcatacccacagtccagaccctttaatcatagactggtgcccttatctgcgcctgtgaagatatgaccggtagggtgtgtcttcttttttaatggggaaagttaaataggaaaacctgaagaggttattgaatcggtgttgagttcaggcgaccctctcactccgtcatttctgtcgcctctcctctcacttggttgttttttttccctctcctgtcttcttcttgtatcttacaggtaaataacttggatcttatttggaggctgttaacatttgaaaggcatgagctcgt

SEQ ID NO: 93657 - DNA, 362 bp, Homo sapiens
gtccctcccacaacacatgggaattatgagagtacaattcaagatgagatttgggtggggacacaaagccaaaccatatcacaacctatgctttgaataaagacaggaaccagagcagcaggaattgtcctaccagggcactgccagtggatatgaacaaattggcaatccctttgacaatcctttgagtccaagtccaagagagtctggtcgtccaagctcaagtcatacacttgccccaagatgctatcagggtggtgagaggaagccccctacaacagcttccaaaggcctcattggttaccatggtggagagccaggcaccttgatgtacagcccctcaaggctacacacaagaggac

SEQ ID NO: 93658 - DNA, 418 bp, Homo sapiens
ctggaaaaagaccaaaagcaaggaggtcacctaaaaggctattgcagtcatccagatgctcaatcttgttggcttggattaggatggaactagagggatggtgagaagttcatggatttcagatattttttaagtggacagccgaaaagatttactgactggctgggtatgagtgtgaaagaaagagttaatttaagggtgatgctaaggttttagcttggcccactatgatggtgaagttactgttttctgagatggggaaatctgtaagtggagcaggcttagatgggtataaatcaatcatttttgaatatgttaagtttgaggtgcccctttacaccaagtgaaggttttcttgacattattaaagtgaacatggagttcaggggagaagtctgggcaggggatctaaatttag

SEQ ID NO: 93659 - DNA, 202 bp, Homo sapiens
gtttaaaatacagatcagaccttcctctatttctctattttttctattttctactcatttaatggtattcgtcattcagttgactgcactagaaaagctgaaaacactcttgtgaatgttaaacatctctgaatctgtttagcacatagcacatttatcaatgcacatttaatacattaatagctaattgcagcaaaaagtt

SEQ ID NO: 93660 - DNA, 540 bp, Homo sapiens
tgtggcatgtggtgtgtgtgtgtgcatgtaagtgtattgtgtatatgtggtgagtgtgtgtatgtgcatgtgtgagtgcattgtatgtgtgtgtgtcagtgtgtgtcagtgcatgagtgtgtgtttgtgtgagtgtgaacgtgtgtatatgaagaaagaggatggaggtaggctcctcatggacaacctcttgggcaaggaagacaataattggttttctcacctagaatgggacctggaggaagaatctagaactcatatccttagggatagatgcatgcccacaaggggaggagagaagaggccagaggagggagcatcatagtcaaagaaaaagacaaggaagagggggcggtcagcaccgaatttcaccagcttaggttgctgatctattcccgcacactctgagcatctctctgattgtgctaagcctctggatatacgaggctcatgacctcaccctcctcttcttgcctggcatgacagagaccagcactgatgtactggagtcagttcattctggcctgtgagagagctgag

SEQ ID NO: 93661 - DNA, 388 bp, Homo sapiens
gttattgctaggatatctaacaaaattggattaaatttttaaaacattttcatcaaaattgattaaatttttaaaaccttttcatcaaaaaatgcacttgaaatcaatttcttccattggaaaatattttaaagacaactataactttacagattaaattgaaattggctactgatgaaggactaaagttcaattttgaaactacagcattgtctcagtggtgaccaacttaataaatgaatattttgtgtttgccaaaattactctaaaatgtctttctttattctaatttacctctgtgagagacttttttctctagtatgattttcattaaaacagaatacagaaaccgtttatatataaattattcctcaagaggaagattgtc

SEQ ID NO: 93662 - DNA, 395 bp, Homo sapiens
ttctgtcatgatgggaagcagaagtctctttctcttttcaccttgaagtccattttctccgccttacccaacataaattctcttctcaatcattatagttgttcccttcaatacactttttgcttccttgcccctgtcttgttctgcttgggaaaagtgtacaaccctggttaaatctgtctcttcacttttcagtgccagtacctgtgcagctgaatgtcactcgagaaaaagacacaaccgtgctatttgcaccttaaatccatgaccacaatgaggccagtcatactgcatttccagagtcacttattcttccactttcctagatgtatttttcacatcttttctgtcaacattctaacatttcctccccgatcttctcagacattgtcgtt

SEQ ID NO: 93663 - DNA, 522 bp, Homo sapiens
tcagccttccgaatagctaggacttcaggcatgtgctaccctgcctggctaattttattttttatagagacaaggtctcactatattgcctaggctggttttgaactcctggcctcaagctatcctcccacctcagcctcccaaagtactgggattacaggcaagagccaccgtgcctggcaatttcaattattttttttaaaaaatcattaatctattacttgaatttggcaattttgtattttaaatgcaaataaaggctcaaaatatttcaaaatactctgattaaaacccaacaaaaataaaatcctccaaatctaggggaaaaaataaaatttcaggataactctgtttaattctatttttcagcctatatatgtatgtggagattgcttgccatccaacatatgttaggatgtctactgaagcacagccaagtgtaacagcaatagtttccaaactttcttcttcattcattaatctattcaacagacaacttattaagcaactacctattgggct

SEQ ID NO: 93664 - DNA, 381 bp, Homo sapiens
gtgttccaatcagcattctgctgtgtctccaattctctaggattaggttttaatgcttaaactcttcagcatggcctgagaatgaaaagcttctcatagccttgttcctctctacctttcttgattcagttgacccctctggactgcctgcagagtgtgtgccccagtcacaccagatcaatttcactccttgaacatgccaggtatgtttatgcttctgtcattcgcataacctatgctcttgaaaccaccttgctttcttgtctaaccgggcaaattatgccttcatccttaaaaattcatctcttttctctagctttctctgactgtttcatcaagtgaaatcaactgatccatctcctggaaacatctcttttcttt

SEQ ID NO: 93665 - DNA, 204 bp, Homo sapiens
tgatactgacagcttgtacaattttgaaaggaccatagatggtgtttaaaaaaaaatggtaactttaattctgccttctatatttcaacttcagcttcatggattatagtgacccatgagaactccttccccttggggtcttccgaggcctgaatcagaaggaaatgagatgtatttgaaatcatctgtgtggccttgtagatc

SEQ ID NO: 93666 - DNA, 400 bp, Homo sapiens
cctttgcatatcacactccctttgtctggttcagtcctattcatgtttccgatcatcgcttcctcggggaagcattcctcccctccatattgaggctaaagtatttccaggggacaaatccttcattgcgtttgtcactgttgttgttttacattgatttggtggcaatctgacaagctctgtctcctgcagaagactgtatgctccgcacaacagggcctgtgtctctgttctccatctcatctctggcacctcacaaggttggtactcagtataactatttgttaggcactaaatgaatggaatgaatggatccctgacaaataacttcaccaaaatcttttattaaagacttgcctttgcaaggaaccctgtggaatacgccaaaagacatggttcc

SEQ ID NO: 93667 - DNA, 210 bp, Homo sapiens
tattctagggccagggtattttattcattaagacctgtacagagtttaaactgatctgttaatctctggtgtcgctgcaataattagacaattgatgggccagaaagcgacctctgtccttaatggggagacatctcatgacccatttttctcctacccatttttcccctatataccaaaatataaccccaaaggacacaagtcactttg

SEQ ID NO: 93668 - DNA, 511 bp, Homo sapiens
gcgggtgcctgtagtcccagctacttgggaggctggggcagaagaatctcttgaacccagaggtggaggttgcagtgagccaagactgtgccactgcactccagcctgagtgacagagcaagactcgatctcaaaacgaaacaaaacaaaacaaaacaaaaaaatcaacccctggcccagcagggtagtgcaagcctgtagacctagctacatagtaagctgaaatggcgggggtggggggtgcaccccagaagttcaaggttgcagcgagctatgattgagccactgcactccagcctgtgcaacaaggctagcccctatctcgggggggaaaaaaataaggaaaaaaatacaaaaagataaaaaagattaggaaatggcaaaaatcaactcccccattctgataaaggtgaaattaaaccaacttttggcatcccacaaattcattcactgaaatttttaaaaagctctccatttaccatgccaactttcctcctttgaggagtttctt

SEQ ID NO: 93669 - DNA, 741 bp, Homo sapiens
ttctgaggcttgtgctctccctccaccttcaggttttatgtggggcttacttggggctgaggacagatgtaggccttagtcttatctctgaaaaggggataaggtgctcctatactctgtgggcaagatcagtctgttatatgaatacaaagctcagacattacttgaaaaatatatattagttgaatcgttggaatagtattgtcccactaagagaactgtattaattttttagtttttgtttatttaatgaggtttagtgaatatcttacatcttgacattcagcaggctagagttatagtgtcagttgatgtttgtcttgagccagaatcctctctggttttaagaggtctggttcataaaactggtttgggatgtggttcttattcttacaggtcagttttcaaatttaaattgattgtagagatagctgtaaaaccaaatatgtgttttattttgccaatatcttatatcggttgtagaggtggctaatacattcaatattgaataaattgagaaccactgtttaatttcattttttcctcgtacattaaacaacgaatctaaaaagtattaaatatttgggcctttctttgcaagttaaaatagtttttctcttagaaataattactgtttcagttataatacaaaatcagtaatctgcagaagcaagttagaatttttcataagtggtaataaaagtagttaaggtttgttccttaggttttgtattataccgg

SEQ ID NO: 93670 - DNA, 185 bp, Homo sapiens
aaagttaagatcatgtaatatgcctcaaccacataaattgataaattaccttcatctccagtcaaccatttacaccattttccaagagatgagttttaatgtaatgtgaggcagctttattctctgagtcatctgtagtacttcttgttactacagccaaagacctcatcagcattttcattttc

SEQ ID NO: 93671 - DNA, 233 bp, Homo sapiens
aaaaaatcaaaatacttcagaataaatttgacaaaagtgcaagatttgtacactgaaaactgcaaaatatggctgagaggaattagtgactacataaatggagagacattccatgttcataggttagaagactcaagatggcagtccctatcaaaatcccagcaggctttttttcagtaattaacaagctgatcctaaaatttttatgggaatgcaaaggactcagaatagtc

SEQ ID NO: 93672 - DNA, 600 bp, Homo sapiens
tgatagatcctgggaggccactctgatcctgccaacgttgaggccagatgagtctttgaaaaacatggtttggcttaacaccagcacttactctaacacccaccatgaatcttgctgaactgaagctatacaaataccttttcaaaagattttttttcattccagatccttcttagaaattcctaaggctcaatgctttgtggaagattctgagaaagaaaatagtttccgatctttgggattcccgagatggtccaatctgcaaaaagttcattgccatttccatcaaggacactgagaacaagagtcttatctggattggatcctgggaattgagaagcttcagcaggtgggaaatgcaccctccacaggctcacacccttgtgggctgtttcagttacctattgcacctaaaattagaaactttaaaccaccagaagccattattgctcatgaccctgtgagttgcatggggacttcctggctggtttaacctgggctcatttgtgtggctacctgcagctggagggccagctgggcggagcatccaggatggcctcatgcatgtgcctggcagttggtgctggttgtcagccgggg

SEQ ID NO: 93673 - DNA, 327 bp, Homo sapiens
gagaattggtgttgaatgatgctgatacagcaagtaagacagactgaaaaaatgttatttagttagtgacagggaggccattggtaatatcatcaagagctgtttgctggaaagggaaggctgcacgctgcatgagagcaggctaagcagtgagaacatatgaggaaatggccacagattcagctgcaaaaagtggaacagagaggatgacaagtgaaaggtagtaagccctgagtttttgttttgttcataatgatttctcttctttcttttctgtatctatctctatctctcagaaggaagcacagttaagagtcaacagaaaaa

SEQ ID NO: 93674 - DNA, 279 bp, Homo sapiens
aggtataagtaatctagagataatttgaagtacagtcttggccatataacaacatattggtcaacgacagaccacacatatgacaatggtcccatgagattataagggagctaaaaaatttccattgcctagtgacatagctgtcttaacattgtagcacaacgcatcaccttttctgtgtttgaatgtatttagagtcacaaatacttactattgtgttacagttgcctgcctgcagtattcatacattaacatgctgtacaggttgtagcctgggag

SEQ ID NO: 93675 - DNA, 825 bp, Homo sapiens
aggcgcccgacatggtaagagacaggcagccgccgctgctgcatttgcttctcttaaaactttgtatttgacgtcttatttccactagaaggggaactggtcttaattgcttgatgaagagcaggagactcatttatgtgagtcttttgagtgaccattgtctgggtcactcccatttaactttccctaaagcccatttgaaggagaggtcgcacgagctgctccacaacctctgaatggggatggcatgggtaatgatgcttgagaacataccaagccccactggcatcgcccttgtctaagtcattgactgtaggtcatcatcgcacccttgaaagtagcccatgccttccaaagcgatttatggtaaatggcagaattttaagtggcaaattcagataaaatgcatttcttggttgtttccaatgatgactgttatctagagggaatttaaaggcaggggtttactgcagactcagaagggaggggatgctccgggaaggtggaggctctgagcatctcaataccctcctcttggtgcagaagatatgctgccacttctagagcaaggggacctgctcatttttatcacagcacaggctcctaaattcttggtctcattctcaagatgttttaatgactttaaagcagcaaagaaatattccacccaggtagtggagggtggtaatgattggtaatgctttggaaccaaaacccaggtggcgctggggcaggactgcagggaactggggtatcaagtagagggagacaaaagatggaagccagcctggctgtgcaggaacctggcaatgagatggctttagc

SEQ ID NO: 93676 - DNA, 707 bp, Homo sapiens
cgtttctaaaataaggcgaggctgaccgaaactgaaaaggctttttttaactatctgaatttcatttccaatcttagcttatcaactgctagtttgtgcaaacagcatatcaacttctaaactgcattcatttttaaagtaagatgtttaagaaattaaacagtcttagggagagtttatgactgtattcaaaaagttttttaaattagcttgttatcccttcatgtgataactaatctcaaatactttttcgatacctcagagcattattttcataatgactgtgttcacaatctttttaggttaactcgttttctctttgtgattaaggagaaacactttgatattctgatagagtggccttcattttagtatttttcaagaccacttttcaactactcactttaggataagttttaggtaaaatgtgcatcattatcctgaattatttcagttaagcatgttagttggtggcataagagaaaactcaatcagatagtgctgaagacaggactgtggagacaccttagaaggacagattctgttccgaatcaccgatgcggcgtcagcaggactggcctagcggaggctctgggagggtggctgccaggcccggcctgggctttgggtctccccggactacccagagctgggatgcgtggcttctgctgccgggccgactggctgctcaggccccagcccttgtt

SEQ ID NO: 93677 - DNA, 759 bp, Homo sapiens
aggcgcccgacatggtaagagacaggcagccgccgctgctgcatttgcttctcttaaaactttgtatttgacgtcttatttccactagaaggggaactggtcttaattgcttgatgaagagcaggagactcatttatgtgagtcttttgagtgaccattgtctgggtcactcccatttaactttccctaaagcccatttgaaggagaggtcgcacgagctgctccacaacctctaagtcattgactgtaggtcatcatcgcacccttgaaagtagcccatgccttccaaagcgatttatggtaaatggcagaattttaagtggcaaattcagataaaatgcatttcttggttgtttccaatgatgactgttatctagagggaatttaaaggcaggggtttactgcagactcagaagggaggggatgctccgggaaggtggaggctctgagcatctcaataccctcctcttggtgcagaagatatgctgccacttctagagcaaggggacctgctcatttttatcacagcacaggctcctaaattcttggtctcattctcaagatgttttaatgactttaaagcagcaaagaaatattccacccaggtagtggagggtggtaatgattggtaatgctttggaaccaaaacccaggtggcgctggggcaggactgcagggaactggggtatcaagtagagggagacaaaagatggaagccagcctggctgtgcaggaacctggcaatgagatggctttagc

SEQ ID NO: 93678 - DNA, 416 bp, Homo sapiens
atcccactgccttcacagagttctgccagagtcttcctcattcagagtgaaatttcaagggatcttgtaactttcctcgtcattttcatgaccagtccagtctaatggcaaagcttccgtcttccgtctaatttaaagcttctttccctccttcagctcagaacacctgcacgggcatagaagcttgaggtatggtggtggtgagctgggaagggtcaggtagggagaagagaagtagggcaaggacaacagagggcttttttgactggtagagttggaatccaccagcatgggtgtgaccagtatacatatgctatcttttttttttttttttctcatgggagtgctttggtggatttcttggagattccccattagtgactttggattggaagcccgggcatgggcgatgtcat

SEQ ID NO: 93679 - DNA, 2158 bp, Homo sapiens
gggctctctataatggaatgatgctccttttcaatacttagagccactgtactcagtttaggagtaactgaaggtgtggatgcatgttaatgggaatccaatttttactatttttatattaataacagcgttctgtagaaacagtctctcccttctaaataaaaactatgtgactgctgttactagtgctattctatgcgaatatcctaataataggattcaggaattctaatgaattgtttcttaattaaggtgaacaagtagactcctgatcaagaggagaacactgtgaatgtctcataatcaatagaccttcattctcttgtagaaaatgtggattttcaggaaaagactgattattttcatgaataaattttcttatacaaattccattttgtttgacataaaagaccctgaatcttaagatatttgtaaatcagaatatttaagaatgtaaaatgaatccccaaatctagtttcctccaaagcacttcttaatgtaggaaatagtttttacaaaccctatgtcagtactaatgttcctgggtcaaacccagtaatattgttagtgtatgttgttacaccttatttaagaggcagagtggttttgagcaagtcagttaacgtgatttgatgaagaaataaggaattatatacatttagacagaagaatattttattttgaaaataggatttcgtgcaataatttttcttgcataacttagttcatataaatatgtacatctgtttttctggcagatgccttaaggtcatgtttttcagtatttgagtaaatctgtatgtagcaatgttctcattgatttcagaaaaaaatatattctttatattgttgccaggagaaatgtttttgtttatttaaaattattatggatattgtgttgttgtatcataactaactgcctcagcaacaataaatatgcagtaagaaaatcctgtaccttagattgacaatactgttactttaaaagaaatatatacggtacaaattgctgattctacatgtgtacatttaacagatactcagttctgcaccacctaaatcaaaatggcatttgtatgctgatgattacatatgtggattgtagtatcctttgtgatgaatctttgataagatttataaagggcattgccaatactttttgactgtgtaaattaagttaattttttgtatgatgtacagtttgtttaaccttagagcttctatagatttctactttattatacttgaatgaggcagaaaagcactgtggaaaatctgtagctctggatgcaacatgcagacataccaaaaaaataataataaagcaaggtactgaagagcaatgttaacagaatgctttatatccagaatgctatgtttttttcaagccacattttagttgaatgaagtaaagttattcaatcttttattttaaaatattggaaagtcacaaatgattacttctttgatatgatgaacctataagtctattcatctctgttatttcatttctcaaatgtgagccttgttgaggtccattatcaaatctacactttggttgattatatgatgtttaggacaaggcagaatttaaaacctgcatgtttagtgcatcacatgtcaagtcaccatccttctgacagtgtaacttccataacgttattttgagagccatttaataatcatatttgaaaaagtggatttcttgagtctgttgtagtttagtacttacagcagtgcctaaaacagcaactaatatgaactgcctgagtcctacaacataaatgcataaagcttttttatgtaaaagccacaggaggggttcaaaattgaacttttccaaagtttatttctcttgcgttagatgaaaaactatttaaaaggactgaaaaccctgagctttttgctcgtcttggtagcagatatctgtaaaaacctacccagaattgtgattttacttcattgttcttgcatccttgaggctacagtataaatcatctccaaacttgactactattgggaagatgtgtataaaagcatcgctttgggaattttttaaaaaatatgcaaaaataaatattgaataaaatctacattaccataaaacacccaaaaatgcagttctaaaataaaattggtcacaattaaaaaaagcat

SEQ ID NO: 93680 - DNA, 1340 bp, Homo sapiens
gggctctctataatggaatgatgctccttttcaatacttagagccactgtactcagtttaggagtaactgaaggtgtggatgcatgttaatgggaatccaatttttactatttttatattaataacagcgttctgtagaaacagtctctcccttctaaataaaaactatgtgactgctgttactagtgctattctatgcgaatatcctaataataggattcaggaattctaatgaattgtttcttaattaaggtgaacaagtagactcctgatcaagaggagaacactgtgaatgtctcataatcaatagaccttcattctcttgtagaaaatgtggattttcaggaaaagactgattattttcatgaataaattttcttatacaaattccattttgtttgacataaaagaccctgaatcttaagatatttgtaaatcagaatatttaagaatgtaaaatgaatccccaaatctagtttcctccaaagcacttcttaatgtaggaaatagtttttacaaaccctatgtcagtactaatgttcctgggtcaaacccagtaatattgttagtgtatgttgttacaccttatttaagaggcagagtggttttgagcaagtcagttaacgtgatttgatgaagaaataaggaattatatacatttagacagaagaatattttattttgaaaataggatttcgtgcaataatttttcttgcataacttagttcatataaatatgtacatctgtttttctggcagatgccttaaggtcatgtttttcagtatttgagtaaatctgtatgtagcaatgttctcattgatttcagaaaaaaatatattctttatattgttgccaggagaaatgtttttgtttatttaaaattattatggatattgtgttgttgtatcataactaactgcctcagcaacaataaatatgcagtaagaaaatcctgtaccttagattgacaatactgttactttaaaagaaatatatacggtacaaattgctgattctacatgtgtacatttaacagatactcagttctgcaccacctaaatcaaaatggcatttgtatgctgatgattacatatgtggattgtagtatcctttgtgatgaatctttgataagatttataaagggcattgccaatactttttgactgtgtaaattaagttaattttttgtatgatgtacagtttgtttaaccttagagcttctatagatttctactttattatacttgaatgaggcagaaaagcactgtggaaaatctgtagctctggatgcaacatgcagacataccaaaaaaataataataaagcaaggtactgaaga

SEQ ID NO: 93681 - DNA, 270 bp, Homo sapiens
gagaatatcaacaaactcaaaaatcaattctttcaaaagattaatacagtttacaaacccctatcaagttttcaaaaaaaaatattaccaaagtggagactggaccacagattttttaaggctttaattaaaaagataatacaattctatgccaataattttggcaatttcaacaatatagacaaattccttaaaacaaaaattgccaaaattcacacaagaaaaaacagaaatacaaatcatcccatggatattaaagaaattgaatgt

SEQ ID NO: 93682 - DNA, 666 bp, Homo sapiens
acatacatctttaaatacttgtgtacttatgtgcatacttctactggaaatatgcccatttaaagtttggtatatcctctcaaagttgaccttccaaaagagccatggcagtttgtagagcttgtgctttgaataaaagactatgagaactttggcttcttggtaactttgcatcctattagtcttaagttgagtttggtatcttttgattcaaataaggatctttgactctgttatgctttctttagtgatctcacttttctgtgcttggtaacccctttgtatttatgtttaagtggttttgtggccattaggtaattgtagactttatatacaaaacttattcagtcatttctttaaaaggtaaactatagggcttagcacattggctcacgcctataatcccagtacttttggaggccgaggcaggaggattgcttgagctcaggagttcaagaccagccagggcaatatagtgaaacccccatctaaaaaaacttaaaaattagctgggtatggtggtgcgcacttgtagtcccagctgcttgggaggctgagggggtggtgagaggatagcttgagtccaggaggttgaggttgcagtgacccgtgatcacaccattgcattccagtctgggtgatagaggaagactctatctcaaaaaa

SEQ ID NO: 93683 - DNA, 442 bp, Homo sapiens
tgaacaccgtgtaccaaacagctatgagctgtggctcgccctttggggcatcattccagacaggtttcatcaccacgctctccacaagtatctgcagctcctgtcctctctctttccctttcttcccttggcatgacaaaccctggcaaagcgtcccctaggttgttacgatgatgcatttggagggcaagtatgtatgcttgcagggtaaaaaaaagccggggttccaaaaaagagtgaacatttacctgaaatggaattggatagaagagaaattgggaagaattctctgttttggtaataggagataatgatatttgtcattacccaaccttgatttgtcagtaagttgcaggtcctgaattaagcactttattggaatgcttagacctcacaaagaccatgtgaggtacatacaatagtgctaagtggcagggggttg

SEQ ID NO: 93684 - DNA, 290 bp, Homo sapiens
agcttctatcacattattggcgctggtagaaagacagagagaaaaaagagtagattcatggagataaaggcattgcatgttaagtatttatcagagtgtctattacatgatgaatgttccaaaatagctaatatcatctcatttagtcctcaggacaggaaactcactgtcctttgtaaatttcaactcatctccctcactttcgagtgctacaaagtttagtcctttgttctcttctctttcctatttacctttggtgttctccgctgttctcatggttccccccaact

SEQ ID NO: 93685 - DNA, 418 bp, Homo sapiens
gaaaaggaggataggaagatttgtgtaaaagtgggcatggataaaagacagtacatctggagtgctcagctctgggcctgatgcccaatcctgacaggtgttgccgggcccttccagggcggctccttcaatggccacagccctgtgggggtgcgtgtcatcccttccctcacacggcaggcttttggcttctggatgacttcagctggggaagtgtggcctccttagtgcctgagtggtctttgaaaggaagggagatagaatacatgtttctgccttttgttgcccttaagctcatcatctagcaggaaagtctggctatttttaaaagagtagattaatagtagtgcttgaaaaccagatagaaaatgatcaccgataaaaaaatgttgaacaattcatggaagacagatgtgat

SEQ ID NO: 93686 - DNA, 917 bp, Homo sapiens
aacaaagttgtttttataggtcttcactgggtggaaaaatattaacaagcaaccaggtcaagaacaaaaaataacaaccaaaacaattagtggtgtcccacaaatagatccagaaattgaaggccatgaaacagagacattggagagtctgcccagtgttcattagttgaaaatctagacttgagtcaccaacaatgctgacatcataaatccagtatgccagctgacttaaggataactcaggtggtttgtagatactgaactgggatgggcatccttatttcaacagcggcgcatgtttggaagagcacgggcccaactcaggactcggagttgccaagcggaccgtttcccctaacccaggcctgtttcctgtcctgaggtcctggtacctccaggaatctattctgttctcagagtgtccctctcattttgtaatggtagaaaatgagaaaatgaaaaacagaccatttttttctttgaagccatgttctgtaacttcctcctgcttcttttgcattttgggttttgccagtacttgagacttccctttttctgaattttagtcagtttttaatttatcattctaataggggccatggaaattagaataataaaggtttgctactgatcataacatagtattaattttagtagattgacagctttttttttcccctctagatttaaatatttgaacagagaataacaggttatgaaactgactaattcaggtctggcctctgccttcctctgtagtcagccatcccccaggtttgctgccctggagttgagcacaccagggcctttcagccttaccattagggaaatgaggcagatagaggaggttgggcagtgacttgcggagacaggtggcaggggcagaggattaaccacccaagcccaacaagcatatc

SEQ ID NO: 93687 - DNA, 593 bp, Homo sapiens
gcaacagagaaagaccctctctcaaaaaattaattaaaaagagaagagttttgctcctcataggtaagctttaactctcaacctgctcttactcgaaactataacaatttgcattaattcaagttctataacccagttctaccatttttccaaagtataacaatttgcattaattcaagttctataacccagttctaccatttttctgttgggcaccgtagcactcactgcagaaaatcccttccatcttgaacattttccaactttgaccctttctttccattccctttccgtgaaacaggcgtgacttcttaatcctgtattgacatggaatgatactctagtcatcttggcttgatctagtgtgcctcattgtcctgatcagaaaaatcagaaactttgggggacctgaaacatcatctctctggacttgttgcaaagatggaaggtaacaccctggagatggtagagcattgagacgagaagagtgtgggtcattgaagacttcatgaaacacagcagccacacaccagctctggactgccccaccctgactttgacattagagaagtaaacttcattttcttgaacta

SEQ ID NO: 93688 - DNA, 322 bp, Homo sapiens
aaagctttttaatgttccaggtttcagaagatgtaaaacaacgatatttgtcaaaatcaaattgggtttatttcctgggacgccatctgtccagaggtctaagaccactttagaatataaagattcccattctcatcccatgtgaccctgcctctcatcctctgaggactcctaggtgaaagaggctaagctctctggattcagcttcaccatctgcactcatggaaaaattcagtgtttttattttagtttgctgtatttattttaatttgttgtaatattcaataaaactaaaacaaagtttgaagaaaggtgatctgtt

SEQ ID NO: 93689 - DNA, 343 bp, Homo sapiens
tacattgtcctgtctccttttgtgcctgttacctttgattatttgtcagagtatttgaaaaactatttttaaaatattttgaggcctagataatgttactttcttccaagaatgttttcatttttttctgcctggtcctaaagtattagcaatctgagattaattcatttttagggattagaattttctggaccattcagatgacttgaagctagactacagtatctgcaaggacttttataatttcagtttactcttatgtctaagaaacaaaccttggggatcccagtgtcaggcacggaggttttgccaggcagcaacccacaccattgagtgggtctgg

SEQ ID NO: 93690 - DNA, 365 bp, Homo sapiens
gactgagccccagaaggcttacatggcttcccagtgtcaaaacgggcagtagggaagggagcccaaatctggtgctcctcagtcctgtgcacagcaataccttgtacatttccattttcctctcactaggcttagaccactctacagaaattacttgacttatctcaagggtactgaacagagttcaccaataagaaaaaacagaagatgaaaacagaaaaaaataacagcaaatgaaggtggtgattttttaaactatagggattgaaggaatccactcttgaaataactaccctgatgctttaaaaccttcagggcaaggatttcttgagaattttattgggaagacagccttcttgtgtttt

SEQ ID NO: 93691 - DNA, 1516 bp, Homo sapiens
  misc_feature (1)..(1): n is a, c, g, or t
ntcagcatttgaatttttatgctttgaagtttggaactggattatgatcttgattaaagaagggtttcttcattgtttcctcaccacttttcccttaattctaagtcatttttttattttgttaccaacccatattcttagaatataaacaggacttgtttttttcagtaagggcccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacacttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccaccatgctgctcacttatgtcatccacttggcccttgtatgacctgaatttgcaacctctggtatactgttatgttctggagaaaatattcaaagatctgccaaatactgcattagtatactgagtttatacagcatttttgtagggttttaaattgcattcaaggtcactttccaagcactttctggttttgcttgtttttctagaagaaaatgaaaagctattccttataataaacatggcagcaagtaaacagtgtgattgtgaaaaaaatattatttatagattttctacaaataaatatttgtctaccaagtaaaatattttgactgaaatgattctttgaaatgcatattgatttattatgtattgactttttaaaaattgaggtataattttcacaaaattctccaattttcagtgtcaaattcagtgaattttgaaaacatatatacagttgtctgtctgccacagtgatcatgatacagaacactttctttaccctgaaaacttctcatttttccttttgcagtcaatcccctgctcctatccttggcccctggcaaacactggtttgctttctatcattagttctgctgtttgagaatttcatataaatggaatcatgcaatgtgtaatctattgtgcctggcttctttcacgtagcattttgagaaaagcatttatactatttacagattgttgacaaatatttatccactaagtaaaatgttagactgaaatgattctttgacaagcttgccaatttactgattttgtcaaagaaaaatatgttatttttgaagtttgttcatcctttgagtgtgtgagtatagtatcagaggcttaattttgtatttatggagctattctaacttgttatttaaaaggaaaaaggtattaaacttgaagcaaacttctcatgatctcat

SEQ ID NO: 93692 - DNA, 902 bp, Homo sapiens
  misc_feature (1)..(1): n is a, c, g, or t
ntcagcatttgaatttttatgctttgaagtttggaactggattatgatcttgattaaagaagggtttcttcattgtttcctcaccacttttcccttaattctaagtcatttttttattttgttaccaacccatattcttagaatataaacaggacttgtttttttcagtaagggcccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacacttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccaccatgctgctcacttatgtcatccacttggcccttgtatgacctgaatttgcaacctctggtatactgttatgttctggagaaaatattcaaagatctgccaaatactgcattagtatactgagtttatacagcatttttgtagggttttaaattgcattcaaggtcactttccaagcactttctggttttgcttgtttttctagaagaaaatgaaaagctattccttataataaacatggcagcaagtaaacagtgtgattgtgaaaaaaatattatttatagattttctacaaataaatatttgtctaccaagta

SEQ ID NO: 93693 - DNA, 127 bp, Homo sapiens
attccgaaagtttcctaggtttcaagctgggagttccttgaaaaagcccagggcgccaacagcatgatgtgatccgctcccatttttagatgagtcactaggacagttttactcaaagaggcagggg

SEQ ID NO: 93694 - DNA, 343 bp, Homo sapiens
tcatttggtcatttctctactgaattgtatttttcttactgattcacaaggcttttgaatacatgaataataactctttaaacaccttgtaaaaatatactctaaaagattaaaaatgaagccagaacccttaagaccagtcagtaaccattaatacagctgaacttatgatcctataccaacacatctaaattactcttctgctatatagaatttactctcaaaatagccaaccaaatttttacttgatagaaaaatcaccaaaaaaattactcaactcagttgagacccgtcacaattaaaaaacaggtcagtaaaacagcaaaccactttttcatttgtg

SEQ ID NO: 93695 - DNA, 323 bp, Homo sapiens
cctgtctctacaaaaaatacaaaaattaactgggcatggtggcatgagcttgtggtcccagtacttaggatgcttatgtgggaggattgcttgagcccagaaggtggaggttgcagtgagccgaggtcacaccattgcacttgggtgaaagaagtgaaaccctgtctcaagaaaaaaaaaaaaaaaaaaagaaagaaaagaaatcccatagtctacaatttgttgtttaaatatgtctcttaagtacagactagatctcagattattggtttttaaaattcaatgtacactctggctatagactctaagttcactgccactcc

SEQ ID NO: 93696 - DNA, 633 bp, Homo sapiens
atactggaaagacaatgctcactgaaagtgcaaatccgtgtgactgatggcagtataaataggatgtgtgtgaattctggcattaatttcagctctgatgctggacattctctcttaatgcctttaataattaccccttgatggtggctgcagcccgtctgcagccatcacagcaaagatgctggctgcagcaagggagacgtcttaatacctttaatagttactccttgatggcagtggcagcctgtctggagccaccacagcaaagatgctggctgtagcaggggaggtgtgactggggctgtgtactccgggggactggcaggggccagaaacaggtaagagccctgcccttcgggagcaaagttgtggccaagcccaggtgctgttgcaaccctgctgggtgtgtacgtgcccagggtggaactgccatgccagcctcctgccacctcagctcgctctggattttgggccctgacaagtgtgggagggagtccgggggggtgctgagggcagctcagcatggacttgcaggtgcacctcagcacaaaccacctgggtgccatagatggcatgttgatggcagcaggcagacaggttcctggatagaaaggggtggttctctggtgaaac

SEQ ID NO: 93697 - DNA, 421 bp, Homo sapiens
tgcccccaggcttgtcaccaccattccctgatagaggagaagtatgtggcagagagaatgtgctgtgtggcccttacctgtaggccagtgctcccagaaaggtgggtccaggtaagagtgagttcacttctgtccctgggcttctttgtaacaaaaacggggcagtttttaagcccagcatctttggcaggaaacagtatctgtgtgaaactcggtaacattgtcttgttttcatggtaaccttctacttacagcagatgatcctagttttccatttaaaggagtgatataaagtttccttttaaaataaatgtattcagggctgaaatccaaccaacgtattattttgtgcattgcttttagcttcttattgttgaaagtgtgaaacatgcgtggaagtggagatagctgcttggtgaag

SEQ ID NO: 93698 - DNA, 586 bp, Homo sapiens
tagcatcagactacatgaaattttattcttgatgttcttgtatgcaaagtggcatcttggtcttggtgaactgaaaatgttaatgtcaccagtatactacacttgccgttctttagctgttgtattgctgagatgctagagtactatggaaattagtagtttccatcttttgtgctggctaaaattgtctaccaagtaaggtgcaaaaccagcagtgattttttttttttttgcatcacaaatatttggcctagaaaaatgccattatatactgcttagttacaagttattaatataaataagtattaaagtagacattaaattcaaggaaggttgttttttttttattaactctagagccttgagtaaacatcttttcaggatttggggtgtcgaaatagaaagtatgggccaggtgcaggggctcataccggtaatcctagcacttggggaggctgacgtgaggggatcgcttgagcctaggagttccagaccagccggggtagcatggtgaaaccctgtctctacaaaaataccaaaagctggctgggtgtgggggtgcgccctgtggtgtcgccactgggag

SEQ ID NO: 93699 - DNA, 394 bp, Homo sapiens
catcagacctgtatagatgttgctccattgtatattttttaattaaaatttttattttaattatagactcacatgcagctacaataaacagtacagaaagatcctatgtactcttttcacaatttcctgtaatgataacatcttgtaaaactatagtataatatcataaccaggatattaactttgatacagtcaacatacagaaggtttccatcacatcagggatttcttacagtacatcaagataagtgtacttatacagtatgtaacctgggattggcttttttcattcaccataattatctggaaagtgactctgattattgcatctatcaatagtttgtttctttttattgctgagtggcatttgacgatgtgcatacctcaagtttgt

SEQ ID NO: 93700 - DNA, 627 bp, Homo sapiens
acaggaatcatacagcatacagcaagcatttaataaggctcctgggtgctgattaaagcttctggaatgggggattccaccacaccagctaacaatataacttttcacatgaggctcttaggcttgtataattctcaaatggaagattaaagagataacctggcttcagttcttttcttactatgtggcctaaagcctgggcctcagtctccccatgtataagaagcaggtgcttagattaatcagtggttttcaaatttttctttagaagcaatagcacctttagttaattagagcaaaaccttatgcaaatccaaagtcttatgcaaatctttttacttctgaaagaaaagtaaaaagaactttggctcagataccaggaagccagggtcagggctgaggtgggcccagtcatcaggggctgtgctcccaggaaccctctttacaagaggcaggtgagaccttccatctgtcctggatgaagccaggctctgtccctatagctcaagcctccttggagctgctggctctgttgattcccaggagacaggagttacccagcatgggcccagggtgcccacttgccaggccggttcatccaggctggccctcggccatgaccttggg

SEQ ID NO: 93701 - DNA, 366 bp, Homo sapiens
gtcttgctctgcgatgcgcttggcaagttgccacaattcttatgtctctctctgcttcctcatctgtgaaatgggcttaatagcacctagggaaggaagaacttgtaggtgctgtgtggattcataaattcaccctcagtgagagctttgaagatgtgaaattgtctctggggacttggaggtgttctaaacctgttgaaccagagacattggcatcttactgggttgcctgtagcagctggagagttggaggcctcagatattgggctgggtgttgggcttcaggcagctctttcctggctcctgaatgagttttagttttctccaaggaaatcttgacttgtcttagcttacacatgggggttt

SEQ ID NO: 93702 - DNA, 439 bp, Homo sapiens
gggctagggctgagcctcaggtgggtctcctgttccctgtgctcccctgcacagcggctccctcccaagctctggggcagctgcaggaggggcacactgggaggagctgctgcagctgttcacttgggcaggacatcagaggactcggacaccagcttcccatcgtggatctcaatcttcttcacaactatggccctggtgaagctggtgtggctgaaggagatggagcccatgccagagccaaagctggagccgaggccatagctgaggctggggcttgtgagaccctcataggccgagctcagaccacctgcatagccactggtggtcttcatatggatattcatgttctgcatcccagactccaactggctctcctcgccctccagcagcttcctgtagatggtgatcttgatgtccagggccagcctgatgttcg

SEQ ID NO: 93703 - DNA, 428 bp, Homo sapiens
tttccattatggtccagattgtttaaattcaactatactctttcacaattaaggaaatgggacagagtagagtcaagagacttttcatgatcccaaacatagttgcagaatattagatttatgacatctagcccagagtatttttctttcctccctgctactatatttaacttatatttctcttccactacatttggctatactcttcgtatgataaagtttttctaaaatttcagtgtattatattgttttgctgattcacatttttaatatactgagtagcctttttagcaagcagacctatgttttatatggtgatttttgtttccatggctcaagtgaatcgaatggatgtcttttcagagaagtgaacagatgttggatatatttctgaatacttcagaaagattggactggttatacacatg

SEQ ID NO: 93704 - DNA, 674 bp, Homo sapiens
tggagatctctttttcataaattcagttttagtcaggactcctgttgcaggtgacagaaaccaaattcaaattggcttaacagaataaaaaggaatgtattggctcacatagctgagaagtccaagaacagtcaggtgcatactgctgaggcggctacgctggcagggtaagcaaaagaagcaccccagcctaagtttacagagaaccaggacatcattttgaatataacttagttctaatagtcaaatggccactcaaggtgacaaataggaacttcagtggtcacccctcggaagcaagctttcaatgtcccccacctgtagaaggctgaaaaacatcctccaaagataacaggttccaatcactggaacctgtattacttattaccattaaatataaattttaattatttaatttaaaatattgtgaatattatgagattgctatgtaacttaaataatattgataatattaattattaatatttatatttaattataagtaaatttataaacatttggcagaaggatctttgcagatccgattaatttatgaatcttaaagaattatgttaaaataatattttgcaaataacctatgtacgtcctcctataaacgttaaatcatctcgattacttataatccttaatacaatggaaatgctatataaata

SEQ ID NO: 93705 - DNA, 389 bp, Homo sapiens
acacttaacgctataattatggaaaataatactgcagactgtgacttgtttctatgaatcagagacaccactacagttagcagtgagtgtaaaataatgagtgtcagaaacttatattgggtgatttcatttttaaaagtaaccaaagtgaaaaatgaagccttgcgtttttgcttaaatgatttacaaaaaatatttgatgtccatcctgggatagggaattcctcccccataactttgaaagtgcagttgcttcattcccaccattcaaaattctcatggagtcacatttagttattcaactatttagcatttattcctataagaccttcaaaatggcgtgttctgggcaagtaactgctaagatagcagtaggccttgtcagcgat

SEQ ID NO: 93706 - DNA, 418 bp, Homo sapiens
cttgatctcttgaccttgtgatgcacccacctcggcctcccaaagtgctgggattacaggcctgagtcaccacgccagctaccttttgtgccatatttttatagtatcttttttatgttttgatacacaaatacttgccagtgtgttacaattacctacagtattcagtacaataacatgctatacatgtttgtatctaggaggagcaataggctataccatatagcctgggtatgtagtaggctgcaccatctaggtttgtgtaagtacagtttgtgatgttggcacaataaaatagcctaacaatgcatttcccagaacatagctccattattaagtgccacattactgcatatgtgtgtgtgtgtgtgtgtgtatgcgcatatgatgtcatatttgaataacttctaagtgcttt

SEQ ID NO: 93707 - DNA, 910 bp, Homo sapiens
tattaagaaattcataaaaattgaaaaaggtgaattcatataagtacttctcgagtgtttgggaggtatttcctatacttgaactgtatataatagatataagtgcatagataacacatggaaatgatgattaaaaagttcagtatttcagtaagattgtgcttttacatgtttgaatagatatttttgttgaagtgaaattgcagacagagcattagctgtaatctgtcctggaagggggaatgccagttttactgtctgagctcagccattgggtttaattcagatgtcgaagcttaacaagccattggtaccagtgtgatatttgtgtggacagtggcatctgaggaactaatcactaaggaagtgtagacgcagcctaactactggcaagtgtgtccttgggccagctcaggattgtggcacattggcaaggagagatcagtattggattgtagtcgagaaagtgaagctgtctccattcccactctgcttatgtgtgaccatggaaatgttctgttctctctctctctgggaaactgtccaatgggtctgaatttaaacttaccagaatggagtaatttcacttcattaagaaatgggtcctgtatattcacgtatagaaagttaaaacattttggagaattagtacctttaaaggcagttattggtttgcttttagcattgctttttaaccaaaaaagaagtgttttagaaattagaatagcctggacattattgttttacctcagttacaagaggtttttcatacttttatagaacctttaaattattatatatacaacttgaaacagcctctcagtctattgtgtttatccatgattctggaaaaataattatctatttgagggaaatgtttatgatcttaaaaatgggaaatacccatggc

SEQ ID NO: 93708 - DNA, 361 bp, Homo sapiens
ttattgttatccttggcaaaattaaatcatgtcgtaaacaatatcccaatcctcttgtcatccatcagactctagaagggtggctcctaatgcttttcgggtctcggaccactgtggaaatttggtgaaagccatgcaactcctcctttggaaaagttatggtagcctgctttagaatataaatgcagaagttcagggtatagtgaactccatcagtggaaccctagaaagtctcaagctttagcaggagtggctgggctggccaagggaaggaacagggaagaaggactggttggatttacaggtctcacggagagtggtggcattgtcacagaaagattatggactccctgccttctaa

SEQ ID NO: 93709 - DNA, 424 bp, Homo sapiens
gtgatggcagactttttctgtaaaggactagagaataaatattttagtctttgtaggccaatctctgtctcaacaatcaactctgccattgttctgcaaaagcagcaataaacaataaattaatgagataaatgtattccagtgaacctgtatttacaaaatatgtgcaaggctagatttgccacacgggctatagtttgccgtcctctgctgtagcatgtcaaaagctctgtttagagtcacagccacttctgacatttagatcagcactaaatgctggactagtgtctccttaatctatcttgttagctcttcagtgccttctagcatatgttgagtttttatgtttcttagcaggagattaacctaaaaagtttagtttgccactaccagaagaaagtcatatataaagtaaccaatgttt

SEQ ID NO: 93710 - DNA, 288 bp, Homo sapiens
ggatgtatatagtaactaggtagtttgaatattaattttcaaagctggaaatactatacaacaataaatatctcctttattgttgttcttttacattgagtttaaatctattaatattagccttttgctctaatcccctttctcctgaagtgattaaaaactaaatgtctttattaaagcagatataccctttatttccagtaatagtacctttgaagagcaagctaattaattctttctaactgcttaatgtaaacaagaaatacaacagttttgtgagtattgctg

SEQ ID NO: 93711 - DNA, 486 bp, Homo sapiens
actcaccagtcaaagtgaggcagtggtagtgagggctatgaaagataagttgggtgcagatcactgtgaagattccgccatcctcaagcggttcactggctcttaccagatcctgctcttgaccctctttgcagtgctggcatcaacagcttccatcttcctagcatacaatgccttcctaaacaagatacaaacagttccagttgtgtatgtaccaactctaggaacaccacagccaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaac

SEQ ID NO: 93712 - DNA, 2203 bp, Homo sapiens
ggtgtttgaaaaactccaactcttctatccagagtgccaaggacaagatgggaagaaaatacacatcaactcctcggcacattgaagtgtttcctccattcagacttcttccagagaaaatgacactgattccaatgaatatgatgcaggtaatgtctgaaggtggcccccagccccaatccatcgttcacttctccatcagtaatcagaccgtggctgttgttaataggagggggcaagttacagggaagattgttggcacagctgtggttcatggcaccatccagacagtaaatgaagatactggcaaagtcattgtgttttctcaggatgaagtacagattgaagttgttcagctaagggctgttaggatccttgcagctgcaactcggctcatcacagctaccaagatgccagtttatgtcatgggagtaaccagtacccagacccctttctccttcagcaatgctaatcctgggctcacattccactggtctatgagcaaaagggatgtattggatctagtgcccaggcattcagaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtgtttgaaaaactccaactcttctatccagagtgccaaccagagcagattctgatgcctataaattctcagctcaaactccataccaacagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtgaacctgggatatggatgatttctgccaacaatattctacagacagacattgtcactggagtaggagtggccaggagtccggggactgcaatgatttttcatgacatcccaggagtagtgaaaacatatcgagaggtggtggtcaatgcatcatcaagattaatgctcagttatgacctcaagacttatctcaccaataccctcaattcaactgtattcaagctcttcatcaccactggcagaaatggtgtcaatcttaaaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaagatcactgtgaagattccgccatcctcaagcggttcactggctcttaccagatcctgctcttgaccctctttgcagtgctggcatcaacagcttccatcttcctagcatacaatgccttcctaaacaagatacaaacagttccagttgtgtatgtaccaactctaggaacaccacagccaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaac

SEQ ID NO: 93713 - DNA, 413 bp, Homo sapiens
gacctcaaacacttgaacccatacccacagtgcagcaggactgttgtgtgtgctccttgtaagtaaaactaatctctgacccatccaagaggttccagtatgctagagcatgtgggaggcttctgcctcatgtcaagacgtgctctaaagtcacagaattgtgttgctccaaaatggcagtggtcaacacaattggctggcagtttagaccacattagaagataatcgctatttttagtataaatattattttcccttttatcttaagggatagtaccaattccattctttattgctaataagttaccagtagtatatcactgcagtgagaatatttcaaaataaccctgtagctttattccaaagacctcagttatagacttactctcattttgtggtcactccaaaaacaa

SEQ ID NO: 93714 - DNA, 189 bp, Homo sapiens
ctcccagcagacagatacgaatcgagccggtaccctgggcaagagagcaagaatccatttcaaaaaacaaacaaacaaaaaaacacaaaactttattctgctctacaatgcagagtattttaaggggggcaagaatggaaacagagagatagtaatgaggttgctacaagagttcagtttagaactggt

SEQ ID NO: 93715 - DNA, 254 bp, Homo sapiens
taaagcactgtgtttccggcatggggtatttcgagggaacaggtattctaacgacagagagcgagagtgagtaagagaaaaagagatgtacttgttgaaggaagggtagggtagaggggctccctgggaagtttcctgggccacctacctgccactctgaggcatactgtttggtttgttctctgaacccagaggtggccccagataatacaaaaaaatggccaacgtttcttttcactgcccttgactgttct

SEQ ID NO: 93716 - DNA, 523 bp, Homo sapiens
aaacagtgctgtcagtgcaacatttgattgcacatccctctaccagagagagcagtatcagctctgctggtggagggccccatggaaagtggcccttgcttggttttcccagggagctagaggacacttctccgtaaggaaacgtgacttgctgttgcatggaagtggggctggctgcctgcttccaatctgaaagacttccagaagtcttcccaccttacctgagggtgcctgccaaattgttttgggaacaggaaaggccattgcagactcactaagattaatgagttcctcactatctcaagcaaggtgttgggtatctccaggtttggggactggcgtacagatcacatttgtctatgaagaacctcgttgtgggagattactccagagtcaatggcagcctttttagatttgttcccttctgtccttccactcaaaactgaaaaattgcccaggctgcccaagagggccaagccaagtagagagcaaggaacaccaggggaagtgtcaagacattaga

SEQ ID NO: 93717 - DNA, 408 bp, Homo sapiens
agacacaaaggggagaagcaagaacattcagttgagggactccttagcaaacgcatctagttagactagaaagtctacaaagaaaatagtaaaagacaaggttgggaaaattgttggaactagatgatggacatagggatttctattaggtgggggcagaagtaactgcagtttttgtaattacttttaacggcaattactttggcaattgcaattactttagcaccaacctaatagactaagggattaagacagaaagtaatggagagatgctgaacttttggtatatagaaacaaaacaaatagttattgattaaaagctttctctttttttttgccaagcattgcagtaagtgctttatgtcaactgtctcctctgagcctcaggcaaccctgtgaaacagatac

SEQ ID NO: 93718 - DNA, 634 bp, Homo sapiens
cacctgtcactggaacaaattcccacagactctcagcccagggaccaaaggacccacaggctaaggcagagggactgagactggcacccccatttggtaagggggtgacctatcagggcagtgacagagagagtccttcgagtccaatagacctggctgtgagtccaggctctgcccagaccctctaagccaccttgaggctgctatttctctgagtatctgtttctagatgttttaaaagtgggagagtcgcatttcctccctcccaggatcacggtacagtaaagagcttagcactctgcctaatacatagaacaagcagcaaatgttcactgccgttgcgatgacagtgccctggcaggtgacctgtgctcaaggcgtcccagtgcacacacacactcacacgcacacagggtagggcagcagatgggacacacgccctgccacaggccattttaaggagtcggggtgggtgaggacccaggcacggtggaggaaagagggaggcaagaagcctttttcagcttccttggtgtcatctcacagtgcctccctcaggaggggaaaagggaggggagtgagaaggctgtttagctgtgttccatactggctgtgcctcacacaaccggcccca

SEQ ID NO: 93719 - DNA, 702 bp, Homo sapiens
gagaattagagcatacattctgtcactgaaattttaaagtggtaccaatttctccaaaattaagattagtagtgtgaagtgaaatgtttgaagggaattttaaaacttatcttttaatgtaaagtctatggtttagttacatctattgtataaacattctaatttgcatctccattgctcaaagacatttatgccatccagatatgttttacataatgccagaaggtgaaattcctcaggtgggggcgtgattcctacctggaaagataacctttatcttccaggaggacaacttgtaactttctggtgtcagcttctggtttagaagagggaggttggggtgccgtcctcactgagctcttgagctgagtacttccagatgtcttctgaataccacttgtttggggaccaaggaaaaataagaaagaaggagtaaaaccaatggcagaaatgaccaagatggcagaactgcatctctgatcctaacttaagaagatttaatgcactgagccatttattgaacattttgtgctgtgatggaggtaggggtaggcagctgaatgaaggcaaaataaagtgagatcctccctcctcaaaacagtcactccccctgccttctaattcaggcaataaagaactcaatgagagtttctttctttctttatcaaatagggttagctgtatgttcccagtttaaaaaaa

SEQ ID NO: 93720 - DNA, 217 bp, Homo sapiens
ctgatatactactctggatttttagtcagttacatgctataatttaaaaaaaatctgtgggccgggtgcagtggctcacgcctgtaatcccagctctcagggaggctaagaggcgggaggatagcttgagcccaggagttcgagacctgcctgggcaatatagcgagaccccgttctccagaaaaaggaaaaaaaaaaacaaaagacaaaaaaaaaa

SEQ ID NO: 93721 - DNA, 402 bp, Homo sapiens
tttagtctagagcctggtatgtgacagcccgggccctctctcctgcgaactgccgccgccaccgcctctgctggccagataattagtccattacgactctcccacctcgggtaggtgggggcagggtgagagcccaccctcagactccttgtaattcaacttcctgtgttttatggaagcaggctgttgggggcagagagtgaaaggccggtccctaggcttggccaaccccttcctcaactcccagcccccacctccctccttccacccaaacccggttgctgtggtgaccaaatgttatttcccagcttcgtgttggaactgctttgtaaaagttttttacatctcttacctgcctcaaacacgaatgcaggctggtctatctctccctgcgtcttgctc

SEQ ID NO: 93722 - DNA, 443 bp, Homo sapiens
acctggcgacttgttacacagagaaacccatgctttacatggtatgaacacgggcacaccctttgggcacttaggaacatggcatggcaagtggtatgctttgtacagctgtgtacctgctacacagaattcgagaactttccatttgtaaagtcaggacttgactaggtaaagggcagatggaaaattttaaagccttttattcagttcattctcttaagaattattccaaggaacaaagttacctgaagagctcatataataaaagtacaaaagaaactgaaactttggagtcactgcacagtaactatctatataaacctcaagatccacgtgaggaaaatttccccataatttccttttataggccaaatggttataattacaactctcctttgaaggcaaaaattactcattaaatggacacagcctgttttgctagt

SEQ ID NO: 93723 - DNA, 445 bp, Homo sapiens
tggcaactgactgtcagcgagagcaagggaggcgcaggagggagcaccagcaagagagagtggaggaaacagagccccggtcctgtgtaactgaatcacagaagtgaccacactccatcgttcttgccctattctgctcatcagaagcaggtcattaagtccagcccacactcagggagagggagctgtaggcatacttggaggtatgcaggcttggttctaaaccaacacaataaagcaagtgtcttcacaagtaagtcacacaaatttcttggtttcccagtggatataaaagtatgtgtatactatagtctattaagtcacatcttcaggctccacttctaattctagttcttttgctgtttccaccacatctgaggtcacttcttcctctcgtcttgaacctctcaaggtcatccatgagggttggaatccacttccacat

SEQ ID NO: 93724 - DNA, 311 bp, Homo sapiens
cgtcatctcggctcactgcaacctctgcctcccaggttcaagtgattctcctgcctcagcctcccaagtagctgggactacaggtgcgcatcaccacgcccagctaatttttgtatttttagtagagatggggtttcaccatgttggccaggccggttttgaactcctgacctcaggtgatccgcccacctcggcctcccaaagtgctgggattacaggtgtgagccactgcacccagcctactaacccatttctttccttcacttacaactgcttactcttcaactcctagttctctatgccaactcatg

SEQ ID NO: 93725 - DNA, 568 bp, Homo sapiens
tgactattatgctcaatttaccaaagaaaaggccgttggatctgtgggttcaatgaacccttagtgatcagctatgtggtctaagttctcactgatctcctctctaagatccctgattgaggtcagaatcgcagaatcaatgggcacttctctattctttcataccaatcatttgatccattgcactgatagtttattgagtacaaaatgcagcttcctcttccacaaaagcctaacaatggtcagctattgccaatggaagaacaattcagctcatcccatcttttctggatcaggtccttatattacccccgccgcccccaagctttacttaaagtcctctctatccctttgaaacatttttctttctggctccctgcttaggttagctcttctcgcttgtcttgtcattaggtggaataatacatgaagacactcctggcacaattactgccttggaattggcccagttcagcttatcagatgatgagtgtctgctatgggcagatgcaagtgatataagcatcagagacacctccttcccaaagaacttaacacatgttagtgt

SEQ ID NO: 93726 - DNA, 294 bp, Homo sapiens
  misc_feature (272)..(272): n is a, c, g, or t
ggagcttcactggaacccaggaggtcgaggctgcagtgagccgtgattgcaccaccgcactccagcctgggtaacagagcaaccctgtcaatcatacatatatactacatacatacagcaaatctcaagctaaaataggaagcaaggggctggcctgcagcagtggctggagaagagaaaggatttggtgacacatttctcagaaatgccgtcactgagaagagacctctcagggcccctacctagcattgtgttcactgccacagcggagngggatcaccgtttctatacaaa

SEQ ID NO: 93727 - DNA, 259 bp, Homo sapiens
agcatttccaaagccacatgtagatccgtccacaaaggggaaaaacttcactgacaaaaggggttaaacacaacctctgacaaaacactgaataacaataagatactcaaatgcagggacaactcctaagaagccaggcctaaaattaaaatttcttgcatccctgagagtctggaagactgtttgcatgtccgagactgtttcctctctggagcaatcagagaggggacatccaaactaatagtccctggatgacatt

SEQ ID NO: 93728 - DNA, 404 bp, Homo sapiens
tgaatctagcaggatcctcagggctacctgggtgcatgcaagaatgaatcagaagcatgccatccgaattccaacaagtgattttgaaataaacttttagaatggggtggtgtgtgctgagttattctggattctttcccatcacaatggcaaaaacatgtaagaaaatatgtttcccatgtagttcctctgaatttatttcttttccaaaataatgacattacagcatggctattttagtgtcactttttggaaagaaacaaattcaagggaggcaaacatacctccttctccttcctcccaaaggcctgctgaattaagaggtggaagctgtaacaacgcagaaacaaggccgcaccgcccatggtggaggacgtgctggaagaggggtagcccttaaactg

SEQ ID NO: 93729 - DNA, 296 bp, Homo sapiens
ctggatccaagccaaaactttaccctagttactaattgtaggataccaaatatgtaaaattaaatgatctttaaggtacttctaagtctaaccttctgtttgataaaatcacttcacctttctacgcctcagtttcaaatctataaaatggggatcattgtcaatgacctgtcagcctcccagggccactggaagatctaatgaagtgatgactaagatagagctgaactccttacagatataagagttggtgatttttttttcagtgccctggtaaaagataggcagtccaaagt

SEQ ID NO: 93730 - DNA, 430 bp, Homo sapiens
cactttgcagatgacagtatctgttaatattgaaactaaaactagtatgttatactttaagttcttactaagatcccttaactgaccttaactgatttaagatgaattcaggcagtttctagttaatgacactcaaatatgctatatgattatatttttatagtactttggtctctaatcctatttaaaattggtaatttatgaacaatttcagcaaaatgaaattatttcctttacaagcttcccaagttgaagagtttaggttgtaaccttaaactttgaatattccaatctttttctttcgcttaacttggaagcatctttccacagctaaattaggaaagttgggttgaccatttagcctcatgggtgtgacccctagtaatttccttgaaacagtgttgaagaatttagagcattaaaaataaaa

SEQ ID NO: 93731 - DNA, 753 bp, Homo sapiens
gttacaggttcgtaaagttactagcgcagaagcattagcaagatcgtgatgtatttcttaggctattgttggcctccacacaaattcatggagttgctggatgtggtttaaagggtacaagatctctgtgttagataatattggagttaatccattcctctgggaggggaattgagtgtcccgaggtagctgttactggaaggatagcattgccccttggtgagactgttaggagagtgaaggagagtgagtgacagatggagctcttgggagtggcagctcatcatttgttggtgcagtacaggccaccagaagaggatggatctgccggggcgctccctggtagtacaaagagcaggaacccgctagaggagagatgtgctttccatgagcgccaagggcccagcctacccccagacagatgtgcccttgagaagtggggactgttggcaccaagaggggttgcctccgcggtggccttcctggatggagctgcccgtgttgagcgcactgtgctctgtgtgggcaggggttccagctgcttcccagccctttcatgggcagccccctggagctccaccaccccaaggagccccaaaaccctcctgctgaacatgccatgaatttgaatgcttgaaggcatagctttaaaaacaaaaaaaaaccctgctttgactgcagggtggtagggggagttagctttgtttttgtcactatttttaaaagtatatttgcagtaacacatttttttca

SEQ ID NO: 93732 - DNA, 405 bp, Homo sapiens
tcccaatgcttggggcctttgcagcctccagactcgccatggccctctggtcccactttctctttcaaactgtctttttctcattcctttgactctgctggacttcgtcacccccatgacctggtgttgggtctgatcaccccaacaaaagaaaacaggaagggggcacctggatttgaatcagggacctcttgatttgcagtcaaatgctctacccctgagctataccccctgcttgtcataagtgtctaataaccacttttcatgttggtaatcgcacccaggagtcctacagcacattgaaagttcctgcttacttttagagagtaagaccagcaactgattttaccacaaactcaccccagaaaagtccatccccagttgccaaaccctggcccctgctca

SEQ ID NO: 93733 - DNA, 484 bp, Homo sapiens
gaatgccattgacttgtcaccaaaggagaaactgaagttagagagtcagggagtatttggagaagcgtggacagttatctagtaggttctgggtaaagcaagagttcagtggccgaatgaagagctccacctaagcgggtctgaatgtcttaggaggattccaggcctcaggctcctgcataattctacggcaagggcaagaagttgtaaaacaggtttttgagcaaaatagccacatagactaatttggcctggcattgtcctaactcttaatacctctctctctctgctcctcagcacccaaagcccacccatatgtaccaaccaactgcaccttcctctaccggcctactcttcatctaccctgggtcccatcctcccgtctcctcctcctcctccctcagagctccacctaagcctgtcttcaaaggcaatgacctgcatacagaattaggccatctcttctactctccaccccatcagc

SEQ ID NO: 93734 - DNA, 156 bp, Homo sapiens
agcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgg

SEQ ID NO: 93735 - DNA, 457 bp, Homo sapiens
ttttaaacaaaatcttattgtaaaaatgaagaatgagtagctgctaaaacatcatgggaaaaatgttatccacttttactttagaacagcattcaaaactactgaacattttataagtgaatcaaatatagatgtttatatagtcttcaataatcacacatttctttagtgccagctcctaatcatattacaagtttttcatgagttcaactaaaatgtgaccatttttaaaatttcatattttgctttgacagtataacttttaagatttctgagatgtagaaatgtagttgacttgatattttctttcacttgtgcatgtctttaaatgttaaaaactaaaaactattgttagagtaaggagggcggatcacgaggtcaggagatcaagaccatcctggctaacacggtgaaactcagtctctactaaaaatacaaaaaaaattagccaggcgtg

SEQ ID NO: 93736 - DNA, 5313 bp, Homo sapiens
  misc_feature (1088)..(1088): n is a, c, g, or t
  misc_feature (2048)..(2048): n is a, c, g, or t
attgttggcaggcctctgaggctcatgcaacatcaaggactccttcatctggagcactttgactctagctctgtgtaaacaggccatcttataaactcattgccatttaacagatttggcttataatcaggggtttgctgtaacttgcatttttgactgtgccttattctcacccagggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtagctttctatgtctttctcatttaacctaacagttgcattgtgattaggtgcttgatttcccccatctctagtgctaggttctcccttcacgcctttattaatgcacacagtcattgccatggtatctttctctcagaccccttttgttgtagtgcttgtagagtgtaaagtgaaacagttttgcattttccatcatttattatttatattttattgttatttattggtaaattcctataaatttgcttttagtgctattatttaaatcatcaaaagttctgagtttcttgtttctacttgtcagttttgttaaaggtgattgaatataagtaaccatgacttgtaaaaaaaaaaaaagaaagcagttactcttggagcttatgccttcatttggcaagggaagtctttttaactagtttatctgatgattttcttacatgagcttttgaaatacctggaaatgcagttttaatatgaacttttaagacagatgtctcttacatgatcaattacagttgctataattctagactctaaatcttctctcctggttacagtgaccatttgaacattggtgagtggagaggggggatatatggtcagcagctgttttgaaatgtcccagttttacgactgttacttgtgaatcagtattggtggatgcttccctcgtgcctcttagtggccatcgtctgcctggtaaaataagatcgcctccccctacgccgtcttggcttttcccctctacttccagtcctnaggttagatgaaaagtaggtgattgaaggagaggattgagggtggaaggtgggctgtgaagactttttgggggcatcctggagtctgtgaatgaagcagtgttgtctatggaagtggggagtagaaaagaagatccccattgacagtgaggagggagggtggctggagttgtcactgcagtcgaggcggagtcagggctgtgggacctcagcggttagcctgactcttcttccccccagcccccacccactgctgtgttgtgtgtgctagagagacttacagggctgtgaaagagtgacctttgtcagtgtcctttttaagacaagtgagtgtaagggtcaatgtgcttgcttggaggtggactggggagacagccttggtgcagcaagaacattcaactcaggaagcatttgactcgttgtacttcagagaccataaatgacaaggttttgacatttttgaagagataataaatgttttaatttggcagtttgagtgattgggaaaaggaatcttaaactaggtgattctacttgattttcagtgtgaagccattaataacgaactttatggctcttttttgaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcnctgtttcacgttttccaaggaacccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctattccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgaagcagcttgatgtgactgctcgtggagtttatgccccagaggatgtgtacaggttcctgccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatccaga

SEQ ID NO: 93737 - DNA, 5771 bp, Homo sapiens
  misc_feature (2506)..(2506): n is a, c, g, or t
aaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaagtgaccatttgaacattggtgagtggagaggggggatatatggtcagcagctgttttgaaatgtcccagttttacgactgttacttgtgaatcagtattggtggatgcttccctcgtgcctcttagtggccatcgtctgcctggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcnctgtttcacgttttccaaggaacccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctattccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgaagcagcttgatgtgactgctcgtggagtttatgccccagaggatgtgtacaggttcctgccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatccaga

SEQ ID NO: 93738 - DNA, 6397 bp, Homo sapiens
  misc_feature (2752)..(2752): n is a, c, g, or t
  misc_feature (3712)..(3712): n is a, c, g, or t
aaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtagctttctatgtctttctcatttaacctaacagttgcattgtgattaggtgcttgatttcccccatctctagtgctaggttctcccttcacgcctttattaatgcacacagtcattgccatggtatctttctctcagaccccttttgttgtagtgcttgtagagtgtaaagtgaaacagttttgcattttccatcatttattatttatattttattgttatttattggtaaattcctataaatttgcttttagtgctattatttaaatcatcaaaagttctgagtttcttgtttctacttgtcagttttgttaaaggtgattgaatataagtaaccatgacttgtaaaaaaaaaaaaagaaagcagttactcttggagcttatgccttcatttggcaagggaagtctttttaactagtttatctgatgattttcttacatgagcttttgaaatacctggaaatgcagttttaatatgaacttttaagacagatgtctcttacatgatcaattacagttgctataattctagactctaaatcttctctcctggttacagtgaccatttgaacattggtgagtggagaggggggatatatggtcagcagctgttttgaaatgtcccagttttacgactgttacttgtgaatcagtattggtggatgcttccctcgtgcctcttagtggccatcgtctgcctggtaaaataagatcgcctccccctacgccgtcttggcttttcccctctacttccagtcctnaggttagatgaaaagtaggtgattgaaggagaggattgagggtggaaggtgggctgtgaagactttttgggggcatcctggagtctgtgaatgaagcagtgttgtctatggaagtggggagtagaaaagaagatccccattgacagtgaggagggagggtggctggagttgtcactgcagtcgaggcggagtcagggctgtgggacctcagcggttagcctgactcttcttccccccagcccccacccactgctgtgttgtgtgtgctagagagacttacagggctgtgaaagagtgacctttgtcagtgtcctttttaagacaagtgagtgtaagggtcaatgtgcttgcttggaggtggactggggagacagccttggtgcagcaagaacattcaactcaggaagcatttgactcgttgtacttcagagaccataaatgacaaggttttgacatttttgaagagataataaatgttttaatttggcagtttgagtgattgggaaaaggaatcttaaactaggtgattctacttgattttcagtgtgaagccattaataacgaactttatggctcttttttgaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcnctgtttcacgttttccaaggaacccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctattccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcagcttgatgtgactgctcgtggagtttatgccccagaggatgtgtacaggttcctgccgactagtgtgggggaatcacggacacttaaagtcaatctgcgaaataattcttttattacacactcagtaagttggaaatattactat

SEQ ID NO: 93739 - DNA, 949 bp, Homo sapiens
gagtcaagatcatgccattacaccccagcctgggctacaagagtgaaactccgtctcaaaaaaaaaaaggatcatatgaattttagagcaaaaactgcacagcccattaatgatagggttgggacaagttgttttaatctttccagtgcaatatgctgtctggactgagtaaaacgggcatttagggtgttcccgaaccctttcttaggtagatagtttttgcaggcagtatacaaagctgtatgtatgatagtttagacctcttattttcctttttatatattaatagttactggatagccaggaatacatacgtatgcaatactgttttaatccaattttacgtttttctctcctttgtgttattttctcattaaataatagcatccaagaaatcataaatacatttaagctgaatgtggcttgaccgagctctttcctcaacacctgagccaggcactgtgctgcctgggacagggtcacgggtgctgtcatgacatgctgctgtcatgtgcctctctctttccagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatccaga

SEQ ID NO: 93740 - DNA, 290 bp, Homo sapiens
atagtctcacctaaaaatagtggtaagtgtctgagtcgttggtcacattcataaaattacaaagtttattttctcttcttactggaaaatacccctttctgatagatttgaaaaatacctctcctgagcatggtggacgtggctcagaggatgagcaggagagcttcagaccttccacgtcaccactgagtcattcttctcctagtgaaatttctggaacgagttcatcagggtaagtgtgtaccttcttttttaaaaaataaaaatatgcgttcagtataggaactggg

SEQ ID NO: 93741 - DNA, 5629 bp, Homo sapiens
  misc_feature (2364)..(2364): n is a, c, g, or t
aaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcnctgtttcacgttttccaaggaacccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctattccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgaagcagcttgatgtgactgctcgtggagtttatgccccagaggatgtgtacaggttcctgccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatccaga

SEQ ID NO: 93742 - DNA, 6803 bp, Homo sapiens
  misc_feature (2752)..(2752): n is a, c, g, or t
  misc_feature (3712)..(3712): n is a, c, g, or t
aaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtagctttctatgtctttctcatttaacctaacagttgcattgtgattaggtgcttgatttcccccatctctagtgctaggttctcccttcacgcctttattaatgcacacagtcattgccatggtatctttctctcagaccccttttgttgtagtgcttgtagagtgtaaagtgaaacagttttgcattttccatcatttattatttatattttattgttatttattggtaaattcctataaatttgcttttagtgctattatttaaatcatcaaaagttctgagtttcttgtttctacttgtcagttttgttaaaggtgattgaatataagtaaccatgacttgtaaaaaaaaaaaaagaaagcagttactcttggagcttatgccttcatttggcaagggaagtctttttaactagtttatctgatgattttcttacatgagcttttgaaatacctggaaatgcagttttaatatgaacttttaagacagatgtctcttacatgatcaattacagttgctataattctagactctaaatcttctctcctggttacagtgaccatttgaacattggtgagtggagaggggggatatatggtcagcagctgttttgaaatgtcccagttttacgactgttacttgtgaatcagtattggtggatgcttccctcgtgcctcttagtggccatcgtctgcctggtaaaataagatcgcctccccctacgccgtcttggcttttcccctctacttccagtcctnaggttagatgaaaagtaggtgattgaaggagaggattgagggtggaaggtgggctgtgaagactttttgggggcatcctggagtctgtgaatgaagcagtgttgtctatggaagtggggagtagaaaagaagatccccattgacagtgaggagggagggtggctggagttgtcactgcagtcgaggcggagtcagggctgtgggacctcagcggttagcctgactcttcttccccccagcccccacccactgctgtgttgtgtgtgctagagagacttacagggctgtgaaagagtgacctttgtcagtgtcctttttaagacaagtgagtgtaagggtcaatgtgcttgcttggaggtggactggggagacagccttggtgcagcaagaacattcaactcaggaagcatttgactcgttgtacttcagagaccataaatgacaaggttttgacatttttgaagagataataaatgttttaatttggcagtttgagtgattgggaaaaggaatcttaaactaggtgattctacttgattttcagtgtgaagccattaataacgaactttatggctcttttttgaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcnctgtttcacgttttccaaggaacccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctattccttaaacctggagaagaacatgaggttattgtttcatttactccaaaggatcctgaagcctgcgaggaaaggcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgaagcagcttgatgtgactgctcgtggagtttatgccccagaggatgtgtacaggttcctgccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatccaga

SEQ ID NO: 93743 - DNA, 6951 bp, Homo sapiens
  misc_feature (2752)..(2752): n is a, c, g, or t
  misc_feature (3712)..(3712): n is a, c, g, or t
aaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtagctttctatgtctttctcatttaacctaacagttgcattgtgattaggtgcttgatttcccccatctctagtgctaggttctcccttcacgcctttattaatgcacacagtcattgccatggtatctttctctcagaccccttttgttgtagtgcttgtagagtgtaaagtgaaacagttttgcattttccatcatttattatttatattttattgttatttattggtaaattcctataaatttgcttttagtgctattatttaaatcatcaaaagttctgagtttcttgtttctacttgtcagttttgttaaaggtgattgaatataagtaaccatgacttgtaaaaaaaaaaaaagaaagcagttactcttggagcttatgccttcatttggcaagggaagtctttttaactagtttatctgatgattttcttacatgagcttttgaaatacctggaaatgcagttttaatatgaacttttaagacagatgtctcttacatgatcaattacagttgctataattctagactctaaatcttctctcctggttacagtgaccatttgaacattggtgagtggagaggggggatatatggtcagcagctgttttgaaatgtcccagttttacgactgttacttgtgaatcagtattggtggatgcttccctcgtgcctcttagtggccatcgtctgcctggtaaaataagatcgcctccccctacgccgtcttggcttttcccctctacttccagtcctnaggttagatgaaaagtaggtgattgaaggagaggattgagggtggaaggtgggctgtgaagactttttgggggcatcctggagtctgtgaatgaagcagtgttgtctatggaagtggggagtagaaaagaagatccccattgacagtgaggagggagggtggctggagttgtcactgcagtcgaggcggagtcagggctgtgggacctcagcggttagcctgactcttcttccccccagcccccacccactgctgtgttgtgtgtgctagagagacttacagggctgtgaaagagtgacctttgtcagtgtcctttttaagacaagtgagtgtaagggtcaatgtgcttgcttggaggtggactggggagacagccttggtgcagcaagaacattcaactcaggaagcatttgactcgttgtacttcagagaccataaatgacaaggttttgacatttttgaagagataataaatgttttaatttggcagtttgagtgattgggaaaaggaatcttaaactaggtgattctacttgattttcagtgtgaagccattaataacgaactttatggctcttttttgaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcnctgtttcacgttttccaaggaacccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctattccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagtatgttgtttttgtcattcttatgagttttttcccagtactttattgaggaatagagtcagtaaaatgctcgatgactttacctgagttcacatgtgttaccagcactccaaccaagatacagaatattcctctcgcccagaaagttcttacgtgtccctttgcagtcaagatttgtcctgttctgatttctgtcatcatagattcattttgcttgaacttcatatatatacatatgtatgtatatattctttgtgtctggcttctttttctcaacatactatttttaaaaatccattcatgttattgaatgtacctatagttcattcctttttattgtttagtattccattaaatgaacgtatcacagtttattcattttcctgttgacttttggatgtcttataatttggaatgattattaattaaggtgctatgaatattactgtatgtgcatttctaaagatgacatacattttcgttactttttagtaaaaatacctacttttacccacaattgcgaggtcacatgataaccatgtgttgaactttaaaataaactgccaaatagttttccctaa

SEQ ID NO: 93744 - DNA, 2318 bp, Homo sapiens
aaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattgggtaagatgctttttctctattattattacttgctattattttctcaaatgacaccacaaagctagtttgtttcaaggagttactggttagcattaattccttgtaagttttgtgcttcttcctaaactgagaacaccgtgtatttctgtgcaagcgtccctaaagttggcttagaaaaacgctacacttatgcaggtgacaggctgcctatggctctgtcttccttatctctcttttgctctgccattccagttttgtgattatttcccctaggaaatgtccagtttagaattgaatcccagaatgagtgagtgcctccaccttgtgagtctctgggtggctgctgtggtggagaggcagcactctcgggtgcatttgtggggcagcttctctctgggagctgtgcttttactgacatggtgcacacggccactggggtgctgtcttctctgccctccggagcaactgcatgaggat

SEQ ID NO: 93745 - DNA, 167 bp, Homo sapiens
gttagcatgtaatactttattatttttattgtttaaataaatcaataaatacctactttaaattttctgttttaatttttaatgtagtaaatattgatataacctcataaagaaaagctcttcagagtcttaagtaactttgaaaagtgtaaagaggtcctgagatc

SEQ ID NO: 93746 - DNA, 701 bp, Homo sapiens
aaccaccatggcacgtgtatacctatgtaacaaacctgcaagttctgcatatgtatcccagaacttaaagtataataaaaataataataaaaagagttgcaatccatccatctgttgacccatccatccatccatccatccatgcattcattcaattcagaggaacagaagcaggttagagttgctgcagtaaggtctgtaaggtgtgatgggtgctgtggttaaattctaaaactgcattctcaagagaagtctgctggttgcactaggatctctagcacagttcagagccccactccagtgtactgaaaaagaatctgtgtgtctgaaactcacatctttaaccagtatctcagtggctcttatgcagcttaagtttgaaaatcactcactatatcatggagcattttcaatatccttccaaagaacttgaacttgaggctcccctcaaggagtaactgaaaggccagatagagatggcagaacttggcttataagtgaatcacttgaaaacctttattcatgcactcacttaatagagtgcaaaatctgcaccaagaactgtttcgttgctgaaaatatatcagtacaagggctgttaggattcctgcctttaggaggctaacaatctaatgaggagagacagacagtgaacatctaatacatatattacatatatcttttggaaatattaatacggt

SEQ ID NO: 93747 - DNA, 145 bp, Homo sapiens
gaaaaccccagagatgctactgtagtcattcaagactggcatgtgactacagaaaaaaaagaaaggttaaatccaagaaacatttcaaacacgattcaaaaaaaaaaaaagggctgtgcgtggtggctcacgcctgtaatcccag

SEQ ID NO: 93748 - DNA, 588 bp, Homo sapiens
tcagggaaacaccagtgagaagcacgtgtctcccctgatgagaagagaagtgctaggagattgagcctcagtcacaggcagatgtgtgtcttgacagccacggtgtgtgtcttgagagtttaaaagatgtgaaagaatgatttgacccattggcttgctcgctgaataagcaccaaggcaagagagcctggtagttgtcctgcatagtctaggaaggacattctgagaaggataactaatacttcatccctcttcaacttgatgcaacctgaagagcaagtccttgggtgaaagtttcttgtccggtaccaaagataggagatagcaggtaaagggaacaagttggtaccatggcaatggtgtcccagtaaatttttattttgttttgttttgtttgcaagaacagtatgggataaacaatagcaaatatacagccttggtttccccaaatcctacaatctcagtgcaggaaggtcatcttcagcagtcagctcagaatagcctcaagggacatgatgtctacagcttctggcttcagaataatgtcctattactgtcaagtggcaccccccaccatttcttcaaagg

SEQ ID NO: 93749 - DNA, 275 bp, Homo sapiens
agtcacaagttcatcatcaatatggtgacctcctgggagcagaggatcaccaggttgcctaaggaggagtgaaccggcccgggacagaatcagagcaggtcaaaactgtgctgattagtagtgaggttgtgcctgtggatagcaattgtactccaacctgagcaacatagcgagactccatctctttagaaaagtgagtaaagatggaaagtataagactgttactacaaatgtcattgttacaaatactttgtttagaaagatattagatattt

SEQ ID NO: 93750 - DNA, 232 bp, Homo sapiens
atccagccccaaaacatcagcctaatggctaccatcagcataaccagaaacattccaaccctaagataaacccctctctgaccagaaacatgccaacccccagatagcctcccttccgaccagagactttccaaccccacaataaacttttcctcacatgaaaacattccgaacctagataagcacccccttccaaaactcttaaatatccttagtctgtaaaaaaaaaaaa

SEQ ID NO: 93751 - DNA, 129 bp, Homo sapiens
ggctgagatagtaaactttatgatacatgtatttttaaaactggcaaaaaatccctacaaacatatagcaacaaatagttttccctttgcttcaagccccaatatatcttagcatgcctctgtttgatc

SEQ ID NO: 93752 - DNA, 241 bp, Homo sapiens
agaatcttccctttagtgttagtgttctcacccttttaatgatgtatgtgccttaatgtaggtctttttacttggtgggccctttaaatatgaagactcctgccctagcaaaaatttttaaattattattttgatcatttcttccctgtttattttttgttctctttttctaggactcaggtttttaattaattgactggataaacatgtcaggcctctgagcccaagctaagccatcata

SEQ ID NO: 93753 - DNA, 394 bp, Homo sapiens
aaatagattcacaggcgctctagacatcaagtgtctaattttagacttactcagactactagatttattagggtcaaagacataaaagataaaacagagcatgttagcaaagaatttggaagctataaaaaaagaaccacatagaaattcaagaactgaaatatacaaaagccaattaagaattcaataaatgagtttaacagtaatatataaagagctgaagagagaattagaggaaactaaccaaagaataaacagataaagaacttggaaatacctcagagaaaataagacacacatgagatattatgaaaagatcccactatgtacattagaagaaccaaaggatgaaggataaaaaaatgatgggaaataaaactaggaagtgaggatt

SEQ ID NO: 93754 - DNA, 509 bp, Homo sapiens
  misc_feature (432)..(432): n is a, c, g, or t
tgtagagatggggtctccctatgttgcccagactggtctcaaacttttgggcttaagagatcctcccacctcaggctctcaaaattctagtattacaggcatgagccactgctcccagtccacttctataaatatacatatatatacatatatatgtgtatttatttttttttgacacagagtttcactctcattgcccaggctgaaatgcaatgatgcaatcttggcttactgcaacttccgcctcccaggttcaagcaattctcctgcctcagtctcccaagtagctgggattacaggcatgcacaagaatcgcttgatatcaagaggcagaggttgcagtgagccaagagtgtactactgcactccagcctgggcgcagagtgagactccgtctcaagaaaaaaaaaaaatttaggttaaaaagttggngaatcggttagcaatgaaaatgaaggtaagtcatcatagactaagaagaagaaaaaggaccaaatctaacatactct

SEQ ID NO: 93755 - DNA, 480 bp, Homo sapiens
cccctatcctgcaccccgcctcacccctgtggagttgatgtgtatataacatttgctgatagctaaagtttatagagccaggcacctgcagagtactttatgtaccttatccatataattctccagttgccctattaagcaggtactatgattctccatcttgcaggtgaggaaacagaggcatggagaggttaagctatttagccaaggtgatgtagctcataaaagaggagacaggatttgaatccaggcttttaaattatttacgtctacctcgcacagagcttgtgcaattggtaagttacatgtctgcctcctctgctcagctgtgagcttttgagaacagatatgatgacttcatcatctgtgtgtcatctttgcaactgagatccaatgcttgtcacctagtaggcacatttgtatatgtatgaatgaatgaattaattgttgatgtgacattgtaaatgtctcataaatctc

SEQ ID NO: 93756 - DNA, 942 bp, Homo sapiens
cttgtctgagtcttgtcctaagggaatcttgtaacgcatctcaggaaccaggatcaaggtggtgtgactcttctgcgtggcttcacctcacgttagattttgtcatatagctagggaagcacctatgtgatatgactcctcttctgcctgagccttgcttatttgggacattgggccttatatctaagccagtatcctaagtgatgtaattctattcttctgcctgagcctttacaattgggtgatgtgacatattgctaagcccaatacttaggttatatgactcttctttttttcccaaaacatgcccatgaaaaggaattttgacatattgcatggcccagcacccaagtgatgttcctcttctgcctggatcctgcataaaaagagagttatggcatattgctgtgccccccaccatgatgctgtaaccctctcctcttgccagtgccagagcaacagaaagtaattttacatatcttgggcacacccagtaggaattttgctttcatcatttgactgttttttttttgttgttgttagtttgtttttaggtggggggattgtgtcatattgctgagcccagcacctagttaatataaccctcatttctagaccctacctagagaatgcattgtgatctattgcttgggacagcacctcagttgtgctaccctcttgacaagttttttttcccctacaaatgggattatgaaatttacattgatccaattcagaggcatgttgatcaaacttaaactgggattccaccaatagtaggtatttgcctatcatctctacacttagggtaataaatttaaaattgtgagttgcatatttgtagaaagctcacagcagcttagaacaccaactcatattataaaaactgcttgggtggtacacagagttttataacagggcctagcaagaggttaagattat

SEQ ID NO: 93757 - DNA, 461 bp, Homo sapiens
gccaggtgttctttagagcgatcattccatcattccacttgcgctgttcagaacggggattgaggggaacgagatcagaggcgtggagcccaattccgtatttcctcttgaaatagcgatagggagagagggaaaggatagaaaaactggaaaaggagctccacgccaaaggcacacttggccccagtgaaccacctggaatacgctgggagcgctgtaaccactaagtaattctgagcaaaagctagggtggattctggatatgccaggccgtcttttggaaaaagaacacacaattaggcacgaagtggagtaagaaaagaaatcacaattactggagcctcggaaatccgagtttcttctgtttaccagaaccgcttgcccagcaatgtttccagagggcgcccggctttccctcttttcccagagcactccccagctctcccaagacaagggtggcg

SEQ ID NO: 93758 - DNA, 560 bp, Homo sapiens
ctacttgggaggctgaggcaagaggactgcttgagcccaggaggttgaggctgcagtgagccatgattgcaccgctgcacaataaggcaagagttcagtgtattcttgccttattttttaaaaatcagctgcaagtttaatttcaagttatgatttgtgtttgattggggttgtcaatcgtgcaaccattggcaaagtgccaacaggttctaccaaaattggtcttttcccatgtggttttagtctggtttgactcaagcctgctgccactgtctgcagccctgctccagaaacttctgcatggcattgggttttattttacattaaaataaatcagcattgcattggaagattgatcatttctatcaatcctcttgagatattggaggtataacttccattcctggcttcttcccttgcttggccccagtcaaacatcacgagtcactctttttagcatcttttctggttcattttggggagtggaaaggatggactcttgtaataagttattcctacaaaaaagcagttcccctatctgcagtgatcctcaagtaatc

SEQ ID NO: 93759 - DNA, 766 bp, Homo sapiens
agcggaaaaaactctaaatcaaatgcactccacattgtaattggaaagcatttcactctttcagataactcatgaaatgaatcatgattttatgtttggacaactgttattataccaaaccattcaagaagctgtattctttttatctagatgtaatgacacaggtaatcagttttcagttaattctgttttaaagcaataggtttgaacatgggttaattaacatatttgtgaatggctgtcatatatattaaaataaagtataccactattaaccttaaaatgatataaaacctgtactgagttcttgctacgtaattcagaagaggtttccaaattttgctatgcttctctattgacattttggtatctactttttatcgtgtctgttaaaactggtaaaaactcatcattaaacatttagaatttatataataattaaaaattcatttagtaagtttgtgaacttatttactcactgagagacaaaatttgggtataataggttacttctttttataaagatgtggatttttaaaacagatagctgtctttctgggagactttagcatttacttagcttagaatcagagtaatggataataatcgttagcgttccattttcagtccatattgcttttaaaatatgaaaagcatataaaatacttttaaaaacctttttatctttctaatatttttttccacaaaccagtctcttgatttctaggtcttctcattgaacaacatttgccttcacctgggatta

SEQ ID NO: 93760 - DNA, 322 bp, Homo sapiens
gccaaatttatatattttgatatctaacaaggctgttctatctcatcaatctgtcttttaaaaaaattattagctcttcatacctctttagataaactttagagttaacctgtaaagtcctaaatgcacagccaatcctactcctttgggagttagaaactacattaaatttatataaagtaagtggacatttttactcattccagtgtaaaatgtctgtcattttattcaagccttttattccatcagaaaaaattttttcttatcagtgtggtacattccttgtttggcttattttaatataaatataatgtaaaattgt

SEQ ID NO: 93761 - DNA, 137 bp, Homo sapiens
ggcaatgcagcagatgataggacagacaaggtctcagctctctgtgcgcgttctggtgggagagatgggagtcacacagccgcatcaggcagtgcaggcagtcacaggcaggagaggaaagctggggaagaaggtgg

SEQ ID NO: 93762 - DNA, 709 bp, Homo sapiens
aagaaaagaaaggaataaaccaaaaagaggatatgaaatcaaggaaccaaagaatgttatttattaatagattaaggagtcccagaacaaaagatgtgcaacactcttggagagtagtcaattcagactagaggaaaagtgagagcttccagaagtgtatctccaagaaaagctgaaactgagaagagtaaatgctgttttgaaaatattgagagattttgggaggatcgcttgaaactggggtcgggggtggggggtcaaggctatagtgagctgcgactgtgctatggcactccagcctgggtgacagagcaagaccctgtctaaaaatatatatataaataaggctgggcatgatggctcacgcctgtaatcccagcactttgggaggccaatgcaggcagatcacctgaggtcaggagtttgagaccagcctggccaacatggtgaaacctcgtctccactaaaaatgcaaaatttagtgggtatggtggtgtgcacctgtaatcctagctactcgggaggctgaggcaagagaatagcttgaacccaggaggtggaggttgcaatgagccaagatcacaccactgaactccagcctgtgcaacagagcaagactccatctcaaataataataataataataataaaatttaaaaaaaagaaaataatgaaagatttacagttctttgagaatttggagagaacc

SEQ ID NO: 93763 - DNA, 898 bp, Homo sapiens
cccagatttatgcaaagctcttgacctgtgtattcaattgactactgatatcacaacttagatattttgtagaatataaaacatatcatattcaaacgtgaactcatcacttctactcattttaaacctacttctccacttgttttcccattttcattgaatggtaccaccatccactaagtttcccaagccataaaccaaacatcatatttaatttttccctctcccttatattacacaaccagtcttatcaactcaatctcctatatttttctcaaactatcccctgctttctatctacaatgcctcttcttgcagtgagaacacttttctttcccatggctaaagttgtaactgatgtccttgcttccattgtgagccctcttccattaatttttcatgctgagtcttatcttctgctcccatgttaagatccttctaaacctccccagtgtctttcagagaaagactagagtccttccttatggcttttaaggttctgtatgatctgatcccttcttactcttctagcatgtaattcatgttttccatacattcttccctagctattccaaactgctttgggtttctggagcccattattttgcatcttgcagccaagctttttactatgcatttttgcagatggattaccgctcctgcttctgcttattccaagcaaactgttactgtgcattaattcagtttactcagcaaatatttcatgagcatctaccaagagtcatgctctgttcttgacactgcagatgaaactgtaggcacaatagacaaaaattcctggccatcttggaattctcattatagtgacgacagagtaattaaaaataaataagcaaatatataatatatcaaattgtgataagtactagggaaaaac

SEQ ID NO: 93764 - DNA, 799 bp, Homo sapiens
ctggactataatttatttactcattcccccattccctcttgagggagtatttaggttgtgttcatgttctgttttttttccctataaataatactgctataaatttttgtgtctatcctgacctactggtgcctgtatttctttaggctgaactgccaaaattgatatggctgagtcagagtatacatgttttaaatttcagcagctgtcaatgagggcttttattgagagttatgctttttgatcagaaatatatattattttgacaaaggtgcagagaagatagttcactagtgtcttagtctgcttgggggctgctgtaacaaattccttagactgagtagcttagaaactacagacattagtttctcatggttcttaaagctgtaagtccaagataaagatgccagcagattcagtgtctggggaaggcctgtttctgattcatagaaatggtgccttcacgctgtgtcctcacataaggtaagggctggatgagctctcttaggcctattttgtaagggcactaatcccattcatgaaggctacactcctatgacctccccaaaggtttcatctcctcataccattaccttgggcattaggattctaacatatgagtctagaccatagcgactgaagaaaggataatagtgttttcaacaaatgatgctggaacaattggatattcatatacaaaatgacagtgaaaacatcaacaaacccagatacttcaatccattcatcatgccatttacaaaaattaactcaaaatgggtcataaatctaaatataaaac

SEQ ID NO: 93765 - DNA, 497 bp, Homo sapiens
ctcactgttatcatttactatcttataagtgcaaaaactaaagtttaaagaggttaagtaattggctcaaggtatcacagctggtaaacagaggcactgagatttgttctcttttggtttgaccctagaaccctctcctaacattttttttttattttgactctgttagaacagaataagtagcaaggacaccataatctttgctgaggaaagatgactattattagtagtaggcaagtggagagtcgtcagtgttccatcagcttttcccctgtgtctctcatcccatgaatgaagagcagatgtgaaaattgctgccagccactcacttgtcagatgagaactgacttggctgtgctcattacaaaattaatttttaggcttattacaaaattaataaggcatgtgaaatatagatgtcctcaagatttataaactttaatttagaagtgtctttgattctaatacaaatctatttttacttacagtaagatagc

SEQ ID NO: 93766 - DNA, 229 bp, Homo sapiens
gggaaacaggaccatgggctttggggtggcgcatgtcaggtcctgtccgggcttcgacatttactaacacagtgacctgggcagtgtcttcatctgtagaatggggtaatgtcagaggcctccatagtgtttgggaggcgtgatgaggccatctgcggagtggttagcagggagccctgcccggctgctgtgttcttaccgtcgttttcctgtgtgtcctccccaccca

SEQ ID NO: 93767 - DNA, 548 bp, Homo sapiens
tttaaagattttttttgctgttttaaactagaacatatttacattgttgtgaaactagaaaatcaccataggaatattattttgtgaatgaatttaaagagatttaatttgctctatccagtgcagctggagacaactaaagtacgactgccaacaaatcctgcctcaaaccaactctctttatgactcattgctccatgttgagaaactcacatcagcccttgatgactcagttcagtcaattataaaccaggaaagataatatttattgtctttcagggtgttgcaagaatgcattaatgtttatagcacattcgtaaaaggtccaaaaacaggatttcatattatatttctagtattcccacatgaatttgaggtgctcttttaaaatctgaacatctatcacaagaactggtataatactttaatataaaaaaattactaataataaataacaattttagtctgttgggagttaagttgcatcatagcaccagatggtcatactagaccagtgctactgtttcttctgggctgggactttggtg

SEQ ID NO: 93768 - DNA, 330 bp, Homo sapiens
ttttcattgcaaaatgaaagatgcattttaatgaaattgaagttaaagaagaaagaaatgaaaaagaaagaagttcaaagggatgaggagaagaaaagacagatggtaatatgactgtcctctaaaggaaatggtttctgttgctaggtttttccacttagctaaagtcatcagctgtttgatgaatagacaatagtttggattaaaaaatatttaaaattcttttattgttcacattcaagatttaaacatgaaggccattagaaatgaataggggcaaatcaagagttctagggcactggaagcatgtcaggagaaaagacctctgtt

SEQ ID NO: 93769 - DNA, 439 bp, Homo sapiens
ctcaactacttgtattttctaaaaataaaatttttgagcccttcatatgctatgataaaatttcagccattatcactacatgcattttatctatttattactgatcctattatatgcatgttggacctttctctctctctttctttctttctttttttttttttttttttttttttgagactgggtcttgctctgtcacccaggctggagtgcagtggcacaatcttggctcactgcaacctccatcttgcaggttcaagtgattctcctgcctcagcctcccaagtagctgggactacaggcacaccaccatgcccagctaatttttttctgttttagtaaagacagggtttcaccatgttgcccaggctggtctcaaactcctgagctccagcaatccacctgcctcagcctcccaaagtgctgagattacaggcgt

SEQ ID NO: 93770 - DNA, 394 bp, Homo sapiens
ccacttttttttcctatatgtaaatatatctttattggggtctgctaaaatatcagttacttttctctaaagttatatgcatatttcataatattgattccgcagtacctgacattttggtttctattatcattggtatcttttttaacattacatttcctctttgatgctgcacttgtatgttaattttatatccaccaattttggtgaactctattaattctaaaagattttctgcacattctcttgagttttctacatagacttccgcaaacaatgacagctttatttattcctttataatgttggctagtattttcttggagatgaagactcgttctattgtctaagctgcagtgcagcagcgtgatctcagctcactgcaacctctgcc

SEQ ID NO: 93771 - DNA, 334 bp, Homo sapiens
agtcacacgcagctccttactgtctggtatgtgggaatcttctgccccacggcagcctgtgcctttgccgaacacctccaggagagccatgtgggggatggtctggacgttgcagggaccagagccgagctcttgagattctctgagtgtggacaaacgaggtgctcagacatggcccttggtggtgtggggacacaggcaggatagctcctctcggtgactcttggtagattgtcttctggtagatgggctgggggtgcgggttctggtgcttcaaggtggttgtcctctgactgtgaaccagagcccagggaccaggcgtcagccccgtgct

SEQ ID NO: 93772 - DNA, 204 bp, Homo sapiens
atgaattttaccttgctgggtgctaaatatttttgtattcctataaatattcttatgctttgttctggaaagcagttaagtaacttgaaaacagtttgatcctttggggtcctgcttttatgaattattaggaaggcctggagccactgctcagtctagggttgatttttccctgctactgagacaaaatcctcctgagtgatc

SEQ ID NO: 93773 - DNA, 318 bp, Homo sapiens
gatctcctgacctcgtgatccgcccgtctctgcctcccaaagtgctgggattacagacgtgagccaccacgcccagccagatgcgattttgccattttggccaggctagtctcgagctcctgacctcaggtgatctgcctggcttagccacccaaagtgctgggattacaggcgtaagccaccatgcccggccaggccaccctatttaaggggacaatttaaagggaacctctgtccgcacatacactccccatctcccttccctcctcattttcttcatagcacttaatatcatctgacatcttacatatttgactt

SEQ ID NO: 93774 - DNA, 495 bp, Homo sapiens
  misc_feature (402)..(402): n is a, c, g, or t
  misc_feature (495)..(495): n is a, c, g, or t
gagagagtcttcctctattgcccaggctggagtgcagtggtgtgatctcaattcgctacaaacactgcctcctgggttcaagcaattctcatgactcagcctcctgagtagctgggactacagacacgcattactagacccggctactttttgcattttgtgtagagacagggtttcaccatgttcccaggctggtcttgaactcttgacttcaaatgatccacccacctcagcctcccaaaggcctgggattacaggcgtgacactgcatccagcccaaaaatcaatttttaaaaaatattatctagccgggcacggtggctcacatttttagcagttatgaatttcttcattggtgccccaagttagatgttttgactatttaaaatgttattgttgacncttaagtattacaagtttatttatttattttttctttaaccacatttcaggtgctcaaacaagttttattttgaaaagggaggagtgataagn

SEQ ID NO: 93775 - DNA, 468 bp, Homo sapiens
cattatttgatatatattttttttacttagaagagtgtttctccaaaactataaatttgactcttagtgtaaaataatcttaatatttgaattatacattcaggttatgccctctatttctagtttgatgaaaatattattagtaatggatgttggggttttattaaatggcttttttccacatctgtcaagatgatcaactggcttttctctattatgactttagatgaatcgttttaatagatttgctaatgttaagacatctctgcatttctacaagaatctgatgtagtcatagtatactattcttttaatatacatctcctttcaatgttaacagtggttatttatgattggttggtccatagtagatttttattttgtgtttcttatctgtactttctgatttttctacaaagattgtgtattacttgtataataaaaataagagctttaaattgtgaaaat

SEQ ID NO: 93776 - DNA, 505 bp, Homo sapiens
ttccatcagaacaagtatcactgaggactaaaaataataataatcataataaataataaggccaggtgcagtggctcacatctaacactttgggaggctgaggcaggatgatcacttcagcccagaagtttgagagactagtctgggaaacacagtgagaccccgtcactttataaattttttttaaaaaattaaaattaaccgccccccaagaatagatgaaatctccaaaaataaagatgtaacttagaagaaataacaaacctgcaagcaaccccagtatttaaagggagtctcacagaaaagattcctatgaagaaaaccaataaggaatcattagaaagataaaagaaccaggaaaaaatggtattgtgaagccgatagaaaataaaaagggagtggctaataatctcaaatgctacagatatccagcaaaaatcaactttctttaaaatgcagtgtcttatttccctaattagaatgttcacttctgtaggtaatataa

SEQ ID NO: 93777 - DNA, 389 bp, Homo sapiens
aaaaatgtctatggggaccttacaatttctaagcttttattcttccaggaaatgatatttagaatgcaactaccatctgatattgccattatttcattaaaaatattaaatttcaatccctaaaacttaggatgtatctacaaagggaaaaattacagcattaaatgcatttttattttttatatattcttctttatacatttattcattaatggagtaattgactgattcattgtttcatttcatttcataaaatcttttttgtgtgtgtgaataaggattggtctgtggtatccctgacactaaaataaacacacacacacacacacacacacacaattgttctagggatctgacttctatctagattcagttcagaattttgcatc

SEQ ID NO: 93778 - DNA, 529 bp, Homo sapiens
aggcttgctgccgcctactgtatggccggccctgtgggcacagctgtcctccacccgcctcccaaggcaccatcgggcccagaatgtgcccgatgagtcacgggcctgggtctccccagcatgggcgcagcaggggggctgagtccgcctgagccccggtgcccagctcagggtctggcacagagcagatgctagtgaatgaacgtcgggctggatgaatgaacgaatgactaatgcccgctccctcaaaccacaggctacaccgtctgagcctgggggagggcagagcccacgggaccccagaagaggcctccgcagctgaggctttgcgtcccagggtcgatgggggagggggcggggcggccagcagccggcgcggcacggggctcccctccttcccgagaaggaatctgggtctctggactgagctggtgacgggggctggggcggggggttgtggcgtcctggatggagagagctgcaggagcagggggcgcgtcccggtttgcgttggggtgtgggacgaagc

SEQ ID NO: 93779 - DNA, 341 bp, Homo sapiens
cctagggtcacagagccagtgagtggcacagctggagtggcatttcagtgtggctgtttccactgagctcttgcagccaccagcctcggagaccaccctgctgaatgagggttccagtctcgactcaatcacctttcacccagtgaccttgagcaggtcctttctctctggtgttagaatcccataagccatagaataccagaaagcctgtgttgtttctgtaacccacaaagatagcacagcccctcctcattccatgagtcccccagtggggtggacatcagggctcagtgtcatggaaatggctcatggggtgactcagatttggctcaggctcaggg

SEQ ID NO: 93780 - DNA, 346 bp, Homo sapiens
tccattctccagaaaaatcttaggatgctgtcatgacaatgccaatttgctagtggtctctacacacccagaaaccatctgtctcactgggccccactataaacttctcttccttctctgagcatcagtataaggctaaagtgtatctgaataaacagaagtcctactctgtaattcaccttctggttttcattttccactcatgccaacaagagaaaaataaaaattttcaaaattaaggttcagattaattttgaaatggctgctttactcattatagtaagataccgtctttgtatattttaaaggctcaaaggagtaatccaatatgtgaaaatacctttca

SEQ ID NO: 93781 - DNA, 373 bp, Homo sapiens
aagcagcagccaagtaaaggtataatatggggcaaaatcccagccttagtgtgttctagcaggggtgctctggagtataaacaatgcctctgagtttgagccacctcaaggcaaaggtgctggtctttcatagccctgcagtcactcagtcaatgactaaaagcctccctagggcaatgtaaactgccaggcacttctggttctctgggcccatgcacaaagtgatgccagtcacccaaagacagtcctcaagagtcacagatgcaagctgttaagcacacaatagctataggatgggtgcacagaaccggtaatagggatcaaggggatctggtcagagctacacagtatctgctacacacctggtgatact

SEQ ID NO: 93782 - DNA, 890 bp, Homo sapiens
cttttttttaacaagcagtttactttgctttcccaagccaagtagacctgcatgagctttgacttcatgattcttgttctttagtggatttacgttattacttactacgctcccttcagtaatccctacgttattacttactacgccagtttggatttgacatattttctcttccagaatgcagtccagaatgactgcagatacctacataatttatggttttcctggctccccaggaaatacatcactggggatgcaggcactccccggaggcttttctgtttcctatcatgatgaatatttatttgatttgaaaaaaccaactcattcttttgatcttgggtgtacatataggtatatacctataaagaaatgtaaataccctttattggccattttatttcctgagtagcattttaaaatgtagtattgttttgtatggactaaataaggctttttctgaagaccccaggcatggttttctgtgaagtgagttgaggaaatggaaactggtgagtctgactctgtgtttgctcagggctggtactaagtgagccccctatgaattttgaactgtcattcatgataattgaggaaagaaaagctgtatcaggagagaaatcagatgcgatgaccatgaacacaaaaagctgccttttttctctgagatgcaggatgtgcatttaaatattaatctcttgagatgagtgcgtttcatatcttttggtagtgcaataaagaaaggtatcagagcttgagtaaaaagatacagaaatattggcacttagtgcatgaaggctttttggaagaggtgagcaagaagtattttggtaactgcggacaagtcatgtaaactttttgtcctttgtctcctaatccacaaagtgagg

SEQ ID NO: 93783 - DNA, 514 bp, Homo sapiens
acaatattaagggctacccaaatgaaaaactagctcctaattttcaagaaatgaacattcttattatcagtaattcagaatgtgctcttaaatagagaatatactaccaaaatccatagtcagatttaaaagcactagatgaaattacactttcaaaaaaaatgtaaaataatacttagcagctggcaccccctatactggagttggagcatttgaatttttacgtcaagactccaaaatgtgagctgacaaacaacatggctaaaccctcaattcaattatgtcaagattgtgtaaggaactaagcaccgaagaagattctgaaataaacaattcctgctttcaaatagctaatcatctagctgagggaaaagaaaagtaacaaccagaatatgataaatattgtgtgaggattttagagaactactgcgtgagtttaaatgagggaatgtgtgtatctacttatggcatgggacatataaaagagatatcacttgaatttggcctaaaaaag

SEQ ID NO: 93784 - DNA, 580 bp, Homo sapiens
atttctatcgttttgcccacgcacccaggatcatgcatgtgaccccatgaaagaggagttcagatgctcttaggagacccaattcttgtactctctccatgtagcttttgtgtttggggaagttggtggggatgtccacttgttaggagtcaaacttcttagagagaaatcagattcaatctgagcctttgaaatttcactaggaattttgctcgtaatgaacttagtaatttgtcatgaggccatagaaggaatatagatccaagtctggtttcgtgtgtgtggcttttccttagttagaaatttccctagaagcgtctttgaagttagcagcattaaagatggttacccaccaacacacaagctcataaactgaacagatgctgggccattacagacgtctttggaaacttctgcctgcaatgagaagccacagggaagcactttatgaggctgcagctgagtcatatggaggaggtggcagctgtggggcagtggggattgagagggagtagtctggatgaagtccctggcagtttggctcaccggtcacaagttgtgatcttggccatattatgta

SEQ ID NO: 93785 - DNA, 451 bp, Homo sapiens
tgactcagcaattctagactgcctcaaaaaaaactctggcaaaaaaatgaaaggactttactcacagagttcttttcacgcctaaatatgtttgcaaccaagttcttcactgtggcatttgtaaaactggaaacaatcaaaatgtccatcagtaggggattaggaacattaattcgtacagtggggaactcagtaccagaaggagggatgaggaagacctattgataaggggcagagtacatatcatataatgcaaatatatatttgctttttcttaaaacagtacaaagataaaaaactaaagtggttgctgtggaggacaggggtcaatggtggaagtgagactgaaatagactctgaagtaatatctggactttgaaattataagtgttttacatattaccaaactaagttttaagatagtccctaaaattgaaagaatagtatctga

SEQ ID NO: 93786 - DNA, 790 bp, Homo sapiens
gagaggggttggtctccctttctcacttgcgtggtgtctgatgagccgtctgcggtcatgtttgtttgttttagtgcttgagaggggttggtctccctttttcacctgcgtggtgtctgatgagccgtctgtggtcgtgtgtgtttgttcctctgctgcttccaggattttctctctcagtgcttttgagcaacttgattacgatggaccttggtatggttttctatgtgttccttgtgcttgtagttcattgagatttttggatctgggtctttgtagttttcatgaaatttgcatcattttgaaacttcatatctgcaggtgttttttctgtccctctactcctcaggacctcaggcatgcaggtatcaggcacgcgggtatcaggcaggtgggtatcaggcatgcagttatcaggcatgccggtatcaggcacgtgggcctcaggcacacaggtatcacgtgggtatcaggcacgcagttatcaggcacgcgggtgtcgggcaggcgggtgtcggcacgcgggtgtcgggcaggcgggtgtcgggcacgtgggtgtcgggcaggcgggcgtcgggcaggcgggcgtcaggctgcttggctttgccccaccgcagctcagtaaagctttgtgcctgttttgtggtttctgttgctgtgtcttcgggttcactcatcttttcttctgcaatgtataatctgctgttcatcccactcagtagttttcatagttttcacttccgcaagttgagtttggatcgttttaaaaaatatctttcgtgtttcagct

SEQ ID NO: 93787 - DNA, 323 bp, Homo sapiens
tggaactgcaaaccctacactcagtcaaattcatagaaatttgctttctcttgctatgatctgttttagattatgtatatttattgtctgcacttgcctagtaatttagaatgaagctcttaaaattggagctttccaaatcaatatcacaatttagagactgataagaaaccaggtatttttactggactatagggggtaaatttaagtggcaaactaacattctgctttgtaagtaaaattaaactcaacagggtttagaatataattcaggttcagctttcatgttctgctcttttagcctttggctttatgcctaggag

SEQ ID NO: 93788 - DNA, 923 bp, Homo sapiens
tgaggtttgatcctgtcatggtggtgtttgctgtttgctttgtagtcttgattgcgtatttgctttataggatctgtgaacctctgtatttatgtgttcttttatggtagtgagtatcattcttatgtatgcatgtttagaacttccttgagcatttcctataggctaggtgatgtagtttgggtatttgtccccacccaaatgtcacattgaaatgtaacccctagtgttggagttggcgcctgatgggaggtgattggatcatgtctgtgaatttctcatgaatggcttagcgccacccccttgatgctgtccttgtgatagtgagtgggttcttgcaagatctggttgtttaaaagtgtatgcccccacagccttcccctctcgttcttgccatatgaaatgcacattccctcttcgccttccaccacgagcaaaagcttcctgtggtctcccctgaagcagatgctggcattgtgcttcctgtacagcctgcagaatcatgagccaattaaacttcttaccttataaattacccagtcttgggtatttctaatagcaatgcaagaacagtctaacacactaggtctagatataacaaattcctttagcgtttgcttgtcaggaaagactttatttcttctttgtttgtgaagcttagtatttggtgattacatagtcataaataacatggttaagcatttgtaaccttcatatctctgtgaataactgctaagagttgctttcttatgcccttaggcttggccagtttgtcatatcttgttggcattctttttttttttttttttttttggtaactacacaaatctcactatattgtttgtattatttaaatagttaatccatttagaatttctataaattaaatgtgttagttaatatctagaggcacatgtgaaata

SEQ ID NO: 93789 - DNA, 545 bp, Homo sapiens
ctgtaacttcttgagggtagaatccatgtctaatttatctttgccaacatctggcatacagaattagttcaagatgagagagtatccaaaatgaatgaagaatgcttctcagcacaggagtgaggagaatgagcttccatatatggccctcagaatacaaagcccagtccttcttctcactcggttcagtaactgccagaggcagcatacagggttggttaagagcacagtctgggggcccactggcttgagttcaaatccttccatgagatgttttgtgtctctggataagttactcaacctctcttacccctcaatattctcatcagtggtgtgggaataacacaggagtagcttaatatgaggagtagcacctacttcatagagttgttggggagattaaatgagttaatatgaataaagcagttgaacagtaccttgcacatagttagcagtcagtagatagtagctagtattattatttgtatgcactgcttctctgtggctctgattgccaaactttttaaatcatgaacaccatagta

SEQ ID NO: 93790 - DNA, 783 bp, Homo sapiens
agcgcgggtgggaagcgtgcgaggagagctgagccagggagttgcggggaggagaagaattagaggagacagcactgatgggagtgacagaagcggtgccggttaactccccaccatcaaaagtatcttctgctgtagtctggcacaaggagtgaaaggttaatagccaagaaagaaagaaggaagaagaaaacagctccccgtacagagacagaggaaggggggatttgaacaaagaaaaaaccccgtgtgcgtcggaaaagtggctgcttatacgtatcccaaatctaaaggaagttttttttttttttgagacggagtctcgctctgtcccccaggccggagtgcagtggcgcaatctctgctcactgcaagctccgccttccgggttcacggcattctcctgcctcagcctcccgaatagctgggaccacaggcacccgccaccacgcccggctaattttttgtatttttagtaaagacggggtttcaccgtgttagccaggatggtcttgatctcctgacctcgtgatccacccacctcggcctcccaaagtgctgggattacaggcgtaagccactgcacccagccaatctaaaggaagttttaaaaggttacttccttttgatttctgttaagaaaagggagtgtttatgtgtttgtttccaaatattatttctcagctgaaaatccattttttaaaacactaccttaaaagttcttctaccactcctgtggaaatatatgagcccatcttcaagaaataacagtttgaaatgtga

SEQ ID NO: 93791 - DNA, 264 bp, Homo sapiens
gatttcctccaaagagaaaaagaagacattaaaatctgtttttactaattcataatcatccatacatgtgcttgctacacaaagaagctcagattagaaagctataataaaaacggagggcacatgaatatgtatgaatatatataaaatcagccctaaatctcatctttgatcactgattctagaaataagtacctataaatagtttgcttgccttcttcatgagaactatatccagactgctagactctcccttaaactcaa

SEQ ID NO: 93792 - DNA, 451 bp, Homo sapiens
gcccataatcccaacacttttggaggccaaggtaggaggattgcttgagcccaggagttcaaggctgcagtgagctatgatcacaccactgccctccagcctgggtgacagagtgagaccctgtctctaagataataatagcaagaagaagaaagatcaacaataaaaaccgcactgttatttaaatttagaaggaggagggagaagaaaacaaaattaaaataaacatcaattttatagtaataaaaatcccgattttttagagatacatatcaaagtatttacagatgaagtgatagatctaggatttgtttcaaaataattgaggggaaggtagacagatgataaaaagctggccatgagttcataactgttgagttgaatgatgggtacataggagttcattatactattctgtctacttttttacatttgaaattatatattcaga

SEQ ID NO: 93793 - DNA, 536 bp, Homo sapiens
cagtgaaatctaacagctgattctcagaccccatgttacccagcctcccagaaagcacagttcaaaaagcagagttatcacctgctcctgcttgaaacactttcttcatttggtttccagaatactaaactcttcattattttctttcttctatttttttggaaacacggtcttgctctgttacccaggctggaatgcagtggcgcgatcacaactcactgcagccttcacctcgtgggctcctatgtcagcctcccaagtaatcggtaccacaggtgcacaccaccacgcctggctaatttttgtatttgttgtaaagaagggatctccctgtgttgccagagctggtctctaactcctgggctcaagcaatcctcccaccttggcctcccaagtagctgggactataggcgcatgccaccatgcccagctaaattttgtaattttagtagagacggggtttcactatgttggccaggcttgtctcgaactcctgactttgtgatccgcccgcctggtcttcccaaagtgctggg

SEQ ID NO: 93794 - DNA, 155 bp, Homo sapiens
gatcaagatgccagcaaattcggtttctgtgaggatcctcttctcagcttgtagatggcctgtaccactgtctcttcacatggtctttcctctgtgccatgttagggctggggagaacacaccctggtgtctttccttatgaggacactaatttt

SEQ ID NO: 93795 - DNA, 2172 bp, Homo sapiens
agcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccattataagtctactggagatccaaaggggtttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtgggtgagtatttttcaatatttaaataggtgtagttgaagtaagatgaactaataatgatggcacttttacagaagagaagaaaaagaaaaagaagaagaaagggaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagaggtaaaactacaaggttttaattagataaaactaattaattttaattaattagtttttaattaattagtttttaattaattaggttttaattggcttctgcatttcacagccccatgtcttaacggagagcttttttatttatttcaagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagtaagtctgtggtttaaattctgtcattggcttaacaatccatcaccattgctaaagtgcaattccaatttatattcaacagagttgcatattagcaacagtaatggcctgtagccaagaactgcacacagtgtgggcgttaacgcaattgctgattaggtaggaaccaccacactcaaacatggaagcacttatttttgtcatgtcacagcaagtgcctccatgttaaagtagagggggccccttaacagatgtaaaaatacaaaataaagcttaaatgtatgagctgcggtcaatacaataaagttattttctaaaaaaataataaaaatgtaaaaggaagacttaccatcaccaaaacatggaagcacttacttctttagtttcaaagcaagtacatccacgtttaagtggtggggagcccagtcttggaaaaagttagaatcctttaacctgtaacaagcttagtaaccttaaaacacaataacaaaaaaattttgtaacaaaaggtgtgctggcttggagacacctccactgaaacatggaagcacttacttttgtttcacacagcaggtacccccatgttaaagcaaaggggatcccttcaaatgaggttagcgtgttctattttggagaagtaaattggattcactcctactaaaacatggaagcacttacttttaaagtcacagaaagcacttccatgttaaagttgaagggagcccacccaacatacaacttctttggacttcagagtatttagagctgaggagaaagaaaacaaaatggcataactttagaagaaaaaaatttttttaccttcctgaactagttcccaaagattcgtgttctcctccagaagggtaaaaggcagggacttcagccacttctatttatactattcttaactcttgaattccttttgcctttttatctcagagaatcattacaagggccttttgttattttaatgtatcagctctcagggaatgtatgatcctgggtgggtctggatccttttttttttttttgaagtatacagatgtcaatgttaacagctaaaaccattaccacaagatatcttcctttt

SEQ ID NO: 93796 - DNA, 1732 bp, Homo sapiens
agcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccattataagtctactggagatccaaaggggtttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaagggaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttccttaacttgtaaataagacttttttctagagacaaatatgatgtataccacaatttttcttaaacattttatttgttgaaattatcttagatgtcagtgtcaggtgatttagtaaataaatgtgttttgaacattaaaa

SEQ ID NO: 93797 - DNA, 968 bp, Homo sapiens
agcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccattataagtctactggagatccaaaggggtttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaagggaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagcatttcacagccccatgtcttaacggagagcttttttatttatttcaagatatagaaatctctactgaagaggaaaaggatactggagatctaaaagatagctctctcttgaaaacaaaaaggaagacaatatccaagccaaagaagaaaacatggacacaagcaacaccagcatcagtaaaatgaaaagatccagacccacatctgagggctctgacattgagtccactgaaccccaaaagcagtgctc

SEQ ID NO: 93798 - DNA, 1355 bp, Homo sapiens
aaattgattgtatttggagtgggagggttccccctacagatagctgtgggatatgtgaccaaattctagccaataagatataaactgggtcggaggggcggggatcggctgtgtggagagggccggggctctcacacgtgaagaagttgttgttaggtctttcagaaagactctttaaaagggaacagagagttgaggcatagtattttttttttcctttcttccttcctcctattttttgccaggaacccagaaatagtggctggaatccttgcagccgtcttgggctatgaggcaacctttgggacagaagccagcatcagggctggtgaatcagaaagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttccttaacttgtaaataagacttttttctagagacaaatatgatgtataccacaatttttcttaaacattttatttgttgaaattatcttagatgtcagtgtcaggtgatttagtaaataaatgtgttttgaacattaaaa

SEQ ID NO: 93799 - DNA, 253 bp, Homo sapiens
ttaacggagagcttttttatttatttcaagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagtaagtctgtggtttaaattctgtcattggcttaacaatccacctcaatggaaacatttcacgtgttaaacaactcct

SEQ ID NO: 93800 - DNA, 1438 bp, Homo sapiens
agcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccattataagtctactggagatccaaaggggtttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttccttaacttgtaaataagacttttttctagagacaaatatgatgtataccacaatttttcttaaacattttatttgttgaaattatcttagatgtcagtgtcaggtgatttagtaaataaatgtgttttgaacattaaaa

SEQ ID NO: 93801 - DNA, 1781 bp, Homo sapiens
agcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccattataagtctactggagatccaaaggggtttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaagggaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagcatttcacagccccatgtcttaacggagagcttttttatttatttcaagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttccttaacttgtaaataagacttttttctagagacaaatatgatgtataccacaatttttcttaaacattttatttgttgaaattatcttagatgtcagtgtcaggtgatttagtaaataaatgtgttttgaacattaaaa

SEQ ID NO: 93802 - DNA, 1075 bp, Homo sapiens
ggagacggaaatgtccgaagccgcagtacttgaccctgtattttgggagtcgaacggagaatggaaactgaaagtggaaatcaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttccttaacttgtaaataagacttttttctagagacaaatatgatgtataccacaatttttcttaaacattttatttgttgaaattatcttagatgtcagtgtcaggtgatttagtaaataaatgtgttttgaacattaaaa

SEQ ID NO: 93803 - DNA, 346 bp, Homo sapiens
atgactccctttgctccaatgaaaaaactctgagctgtatattctacactggctcccagagttccccagaggcattgagctccagttgcccacagtggtaacttgctcaataacgcactctccattggcttccttccttccctgtcttacttctccagtccctgaatggtgatccctgaatgactgtttctcaattaagccacttgcacttgaatccttgtctcaggtactgcttctggaggatgcaaactaagacagcgatgtgtgaaattcaaatatcaaaaggtcattgaaaaagcaaagaaataaatcaacatggacctttagtagttgtggacaatgctat

SEQ ID NO: 93804 - DNA, 838 bp, Homo sapiens
agctgggactacaggcacgcgccaccatgcccagctaatttttggatttttagtagagaaggagtttcaccatgctgaccaggctggtttcgaactcctgacctcaagtgatccgcccgcctgggcctcccagagtgctgagattacaggcgtgagccaccgcacctggccaaaaaaaggcattttgatttaggttgctgtgtttgcttgttgataaagaaaactcaatcgggacactagttttgtgctcagctttaggccgggtagctaatgggaggatgtccagcctgtcactgtgctcccagcgcaaggaaatgggtgcccacctggaatcaggagaagaggcttttccctcctgttctgcaaccagggtggagctatctttccagggaagccagctgagaggttttagggctttggttattttatgggggttttaaacctcctaacttttcaatgacaaatggctcccaggtgccatagtctctgttaaatcctcaaacattcacaagcacacactgccaggggtacgggttgtctttcacctgcatgtttctaaggctctttattcaatctcacggtgtcagtgtccagttgtcaaagttatgaatcttcctcctgcttctaaacagggctgacagtatactctcgtctagtctaggaacatgtctgctgctgggataccctggtaccaggatttgagggccacgggtggcatctctgagagctgaaaatccacagagtgcctgtgggaaagccaagcccttggctgtgtggcttttctatcccttggatttacaggtctgggaattggctgcttcttagttataaccccagt

SEQ ID NO: 93805 - DNA, 379 bp, Homo sapiens
gggcatgcaaagtggtacagacttttaaagaaaggaatttggcaacatctgaaaatattacctctgtgtttaccctttggtctagcaatcccacttctaggaatctatcccaaagagacaacagaaggtacagaatgcatacagttataaaagcactatttgtaatagcaaacatctggaaacaacctgaatgcctatgcgtaataaggtactagtataataaactgtggtatatccttccagtgtagtactatgcagctgtcgaaagaaatgaggaagaagtatatattctgctagggtgtgacctccagatacgttggtaagttaaaaaataaaagcaaggtccagaataatttgctcagtatagtactttctaagt

SEQ ID NO: 93806 - DNA, 732 bp, Homo sapiens
accatcccttagtccatctctaatttcctccatttctccctgtccttgcctatatgctgacataattttatgtagctataaaaaagccatgtttaaaattataaggttagcattttcttatgtggtgacataattgctgttactactattataagtgattgcataataccttactgaaacagtcttaggataacacagtattttggttttacacatgaaagaaagattcaaaaattgttgggacaagtacctatccatgaggaaaaaatatatctttatcccagtccttacagcacattcaagatagactgaataattaaatataaaaaattaacataaaccagaacaaatgggtaagtgctttttgatcttggatgggaaaggcctgagagtgacaaaaacttaagaaattgccaggataagactgataaatttggctatattcattcaacaaacatttattgagtgcatattctatatgcaaggttctgctctagacactggggatctcagagttatctaaaatgacaagtagggagttgagctatcatactctcacacaagtcagtcagtcatagccaaagggctgtccctggggccttaagcctgggcactctggggctctctgggaataggagcaaagcagccccactgacctgaggacaggtgccagccatgggaagccagagcacatcaagccccagtggggatgtccagaaacagtgaaagggg

SEQ ID NO: 93807 - DNA, 549 bp, Homo sapiens
ccgggttcacgccattctcctgcctcagcctcccgagtagctgggactacaggcgcctgccaccatgcccggctaatatttttgtatttttagtagagacggggtttcaccatgttggccaggatggtctcgatctcttgacctcatgatccacctgctttggtctcccaaagtgctgggattacaggcgtgagccaccgtgcccagcctgttctcaatctttcaatcttgctcttttgagagtctgtctagtcagtcagacaacagataattcacactgcttgggaatatatgtatttcgggccatttctctctccatgcaattgagagatggagagtggatgactgcctggactctcagggccacccctgagtgcagctgcagtgcagtagaagttcactttcatcttgcattgccatgcagggcagactcatcctggtttttgcctccgttgtcagctggttgtagagatcaccccctcccaccccaaagaggccatagggtgagctgagggagatgcattggcatgacataggtgggtgacatga

SEQ ID NO: 93808 - DNA, 591 bp, Homo sapiens
gtttgaacccaggctgcggagattgcggtgagctgagatcataccactgcactccagcctggacaacggagcaagattccaactccaaaaaaaaaaattaaaataaaataaataaatcagtactagctatagaataagatccaaaaatgtggtgaaaactgctatgttgaatcctctcctcccacaggatttgcaggtgttcattggcaccatatctgtcagtggaaacatatctcttgtttctcctgaggagaatggatgtcttcatgagcctgccagatatttctgttatatgcccttgtaaatagacacttatctaggatgaatagtaatttataatggcgaaatagcaaagaatttggatctaatttatgttatgacctatttacccccagcgtgagaatgggaaggtaaaaacttccagacttcatcaattgctttccggtgaaatttgaaaattaactagttggataacatttctagttatgtatgacattttctgatcccatttgcttaaagtgtaacttctgaaatatttatatgttacactgtaccccatgctagtctagtggaccaggccttgatcctctc

SEQ ID NO: 93809 - DNA, 293 bp, Homo sapiens
gctcactcaggcttcattcatttaaaatgaaaacaaaataaaacaaattttaaataaaataaacaataatgtcaaataaatgttcaaataaaataaacttaatgtggatttaaaatactgaattccattttccttataagatttaaacagtttgattaaatgtgaccatcagttttgtttttcgttttctgtttttaaagagtttatttgagcaggcagcaccaggccacatgcaattgagggcttcacctagggggcttgaggggaaaacttttataggtgtttatggaagc

SEQ ID NO: 93810 - DNA, 394 bp, Homo sapiens
gtctatggtcatgcttccttctcctcacttggtctcaccccagcttctcttcaagttgctgctgttctctgctgctcctgctttctccctctaaatacttttcttgctctccctgcccctttttgcaaccttttatttcagcctggcagtggtttctaaaaacccgtcggaaatttagcatatgtgacactgtgttgctaacctgtattaactctcaagctttggtctcagcaagaacgagctccatatgccaagaggagggaggaggaatgacagggtggactgtgacaggttctcctggagaccatgaccctgggagcaggggtgaaggcctctggagttccctttggaggtgtcctatagtctgagtgaccagtttccctcttgcttgcag

SEQ ID NO: 93811 - DNA, 376 bp, Homo sapiens
gcacacccagaaacagaaagggattaatgtagaaacagaaaggaattcatacagtgatctcattattagtagtagtattagtactagtatctctcaccttgagagaaaaatttattcatttattagcaatggggtcttaccatgttgcccaggctggacttgaactcctgtgctcaagcagtcctcctggcttagcttcccaagtagctgggactacaggcatgcaccaccaaacccagcttaattttgtacttctagtagagacagggtttctccatgttggtcaggctggtcttgaactcctgacctcaggtgatccacctgcctcagcctcccaaagtgctgggattacaggcatgagccaccaagccctgcc

SEQ ID NO: 93812 - DNA, 351 bp, Homo sapiens
gggcaccaggatcagaagtggagaaacaatacctaatagggagaccaccatgtgggcagaaaataaagagataagctcaaaagcatcaattttccttttcatgcacatgtttttgtaatactaatatagtttttaaaacctgtcaagaatgacataatcaatactctaaaatctcttagagcaggaaataattctagtaaaatacctagtacgggccgggtgcggtggctgtgttcatgtatgtgctgcgcatgagtgtgtgtgctgtgtgtgcatgtgtgtgctgtgtgtttgtgtgtgctgtgttcatgtgtgctgtgcatgcgtgtgtgctgtgtgcatgtgtgtgct

SEQ ID NO: 93813 - DNA, 180 bp, Homo sapiens
gatgaaagttagaaatggaagtgacaagcacacctgagtgaaggatgagagctccagctgccttttccagttgtattcccatgtagctgagccaaaggctgatctcaagtttattgttacatgcccatttaaggcttctggccattaacacttttgattttttttggcttgttattttat

SEQ ID NO: 93814 - DNA, 411 bp, Homo sapiens
tttgacaaactacaaagaaaccattccatggaagagcaaccttcttgacactggaagtaatacaagtcttctaaagaataatagagcaccgctagcaagagccataaaaatcctgaagccctctgaactagtaaaaccactcttggtaactttctctaaggaaataattacactgaagcaaaaagctatttaaaaatgttcactgcaccactatctataacaaaaaagtggaaacccaattcccaacaatagaatggttaagtaaaaaccttacagccgggcgcagtggctcacgcctgcaatcccagcactttgggaggccgaggcgggcgcatcacctgaggtcggtagtacgagaccaaactggccaacatggtgaaaccttgtctctaccaaaaatacaaaaattag

SEQ ID NO: 93815 - DNA, 305 bp, Homo sapiens
tgtgttccaaacaatagcaagaagataataagatgaaatccaagcgtatcagttttatttgcccctttcactcattggtaaaatggacaagtgggtaaattaacataaattaacatgtaaagatttagttatgaagtataaaaagtactatgaaaatgtaacagggtaaaataatataggaaagtatgtatcctatgtgtaagaaagactgctaagggaaagtctcttaaacataaaaaaataacaataagatgctataggcctggcgcagtggctcacgcctgtaatcccagcactttgggagg

SEQ ID NO: 93816 - DNA, 304 bp, Homo sapiens
caaaattgatatcagatttttatttctttgttattatattggatatgtccttatacaaatgaaaaaaccctgtagattagcacatatattatttgtggacatattacccaaaagaaaaaagttttaataaaactcctttgtcatatagatttttcatgacaaaaactaaagttttgttagttacagaaagaatattttccattttttcacttatatatttcactggtgaagccacagaggaaaagcacatcattctgcaaagcttgcagtcttggcagaatttcaacatgttctcaaaacctaa

SEQ ID NO: 93817 - DNA, 866 bp, Homo sapiens
gtcagcaaaattttattgaacttagggattaatacagctttgtaattcctataaataaaaatagtttgtatatcctttatttaattgatcttaaattctagaacatttcgcgtcataaagtccaaacaatatacactgagttcacactttctgcaatgcctaccatctcaagttaaaaaaagtctcaaattttgccttaatgtaaaatggctctaataagatatataatatttttgtcatataaaatattgcatattgacagcaatatcccagtggctgatttattgataatatctttgaccatttgaattttttttcctattatatataaggaaatacaaactaggtaacaggaagaaatgagaaaaggtagagagagacaatagtgaagactggtggacattggactacaaaagattactgcaggattcttctatgatgctgattacagctttatcttatcaagctttggcattgaagaccatgtgaattcatctccaaccctgggagtgaaataagaactttcttttttgcttctgaaattttaagctctatacggaaacactttttacttaatctgcatgacatcagagaaagagacttaccagcttttgaaaccaaaagaagagcatcccaggggaagtatgcatggaagcaccaagaggcatggagggaatcaaagccaaatggctgtaggtatcccatctccattggctgaatacttcgaggcttcagcctgctgtgaagaaacatttcattcattctacagtttgattcacttggttcttctttggcttctcactgcaatctatcttcagaaaaaagcgcagtgacaatgccgcatgaatatggaagtctttgtaaca

SEQ ID NO: 93818 - DNA, 189 bp, Homo sapiens
gagagagagagagaggatggagctacaattattaagcagagtcttgcataaaactctcggaaactcacaaccagaaaaaattttgataatcatcgggttgcagcaaaatgctacataatccaaattcataggtcccatacctatgaagactggcaaactccttgtctgtccacagacatttcgtgcagg

SEQ ID NO: 93819 - DNA, 425 bp, Homo sapiens
aatgctctatgactctcttcctttgtcttatagacatatgttagatgtacaatgtacagctaagttaaaataaatagcttgcagagcacagagttgcagagctggagggggaaccttaggttgtttttggaagcagtgtgttctgaaataattaagttacttaaaaacccacttccgttgagcccgatgagttggaagcaatggaattgggaaggagcacttgccgaagagcaaaatcaatggggaagattctattagcttaattgtttattagtttggtgcctggagctcatccattcttcaaacccagggacgtgactggcctattccttcctcctgggccaaggcccatccctggcagggccctgccatccccctgccaggtgagtcagggaatgccctggtctgatgctgattctgactct

SEQ ID NO: 93820 - DNA, 443 bp, Homo sapiens
ggcacatgtggggaaactgaggcacgggatggttggctaatctgcccaaggtcacagagccagtgagtggcggggccgagattcaaacccaggcagtgtgaagttcatgaagggaaaagctgaacttgctggaaccccttcagactccacgctcctggcctggctgaaggaccctgctgactctctcccccagctcacccctccgggggctgccgtcctggctgtgacctgggcctggtgtgccttcacagctcactcctgctgttgaactccccctcttccctcaggctcagcacagtcggggtgcttcctaggggtgggagtgcaccctcgcagcacacctgcctccctcttggcagtcgctgtgagcatagtgaagccggccattgcacctttgcccattccccgggtgaaacgccagctccagcagggcagggactgag

SEQ ID NO: 93821 - DNA, 286 bp, Homo sapiens
catcatttattgtcaggtaagcaaaaagaaacgtccctgttttagagcagggtaaagggattggaggttggggtttggttgttcttttgaacatttagcagttgaaatgagtcttgtatttgcataattgttaccacattatttttaaaaattcaacatttcaagccaggtgccatggctcatgcctgtaatcccagcactttgggaggccgaggcaggtgggatcacttgaggtcaggagttcaagaccagcctggccaacatggtgaaaacctgtctctactaa

SEQ ID NO: 93822 - DNA, 466 bp, Homo sapiens
cactccagtctgggtgacagagtgagatcctgtctcaaaaaacaaaacaaagcaaaacaaaacaaaaaacaaacaaaaaacccacttttgatcaggcatattatgttatggagacatcctaaagaagggagggtgagtaggcagggacttccctccccatcaaaaatttcatcattgcacacttacatcgtctgacatgattagacggtgtgtgtccttcacaggatcctcaagcttcctgagggttagttcgtttgtgcagtgaaacatcttccctgtaagaatgctactacctaggagctggaaacctgcatatcatcactttattggttgactctaccattattatttttttaaatgaaacactttgaatgtggccttattaaaaacagaattaaatattagtaaatcataaatataattatgtaagttaaattctaacgataataaagaataaataaaagac

SEQ ID NO: 93823 - DNA, 482 bp, Homo sapiens
gagacagagtcttgctctgttacccaggctggagtgcagtggcacgatctcagctcaccgcaacctctgcctcctgggttcaagtgattctcttgcttcagcctcctgagtagctgggattataggcatgcaccactaggcctggctaatttttgtatttttagtagagatggggtttttccatgttggccaggctggtcccgaactcctgacctcaggtgatccgcgcacctcagcctcccaaagtgctgggattacaggcatgagctaccatgcctggccttctcatgtgttttctgattaaggctcttgacttccaaggctgtgtggggagatggggtgggggctcttggactgatataaaactttgtcaaatgtagttctttgaatggagcttgaaacgccgcatattcttgctcccacaaggatagtgggcatcatgaattaataaaacgtcctaggattctgcaagctagactggt

SEQ ID NO: 93824 - DNA, 320 bp, Homo sapiens
ggaaaaaaaaaaaaagagcttgatgtcataagcacccataaaccattatgcatcatgttggcagtatagtatataaatacatggtgctgggattacaggcatgagctaccatgcctggccttctcatgtgttttctgattaaggctcttgacttccaaggctgtgtggggagatggggtgggggctcttggactgatataaaactttgtcaaatgtagttctttgaatggagcttgaaacgccgcatattcttgctcccacaaggatagtgggcatcatgaattaataaaacgtcctaggattctgcaagctagactggt

SEQ ID NO: 93825 - DNA, 722 bp, Homo sapiens
gcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtacgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataaggtagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgtt

SEQ ID NO: 93826 - DNA, 119 bp, Homo sapiens
atatttctgagttggttggcaacatgtgttatctaggagattttacataaaaatgtacatttccttgcttctcttgaagagtggaagcttggcctggtgcaggggctcactcctgtagt

SEQ ID NO: 93827 - DNA, 507 bp, Homo sapiens
gttgtctggcttcactggtaggattctgaacctggattagatatacagctgtccaatggatcagcttcccacatcctagagttccattatggagttacaaagagaatgacagcacttggcaagtcccaggcctaatcatagcacagagaagtgacttttggaaggtacattactaagcaattaggacccatttaataaattacctcttatggaacactttgaaccctagtggtctgaagaggttaatgcacctctcacaactgagtgctactcagtttccaggggtaacttcaaggccacagctaatccaaaccttcttctcatcaatggcctcttactcttgagccacttctgtagtctggcatcagtaagcccacacacttgcactactcccctctgcgtgccagatgcttcattttcttgcagctgaatccattgggcgcagtgctcatgaggccaaaagactttgtgctgcacattaacttcctccttgggctttcatgcttc

SEQ ID NO: 93828 - DNA, 228 bp, Homo sapiens
agaaatcaagaagaaatggagtttagcctgaaattgtttttggagatggttggaagatttagaccaggacagatctagggttgacaggcaatagagaggggctgattcagtgttcgatgaaggatgcctgctgtgaggaacctttctggggacacccaggaggctggcagtgccctccaaaccatgttgggccagttggattctcgggtgtccacagcaacatgggac

SEQ ID NO: 93829 - DNA, 1068 bp, Homo sapiens
aatgatagactggattgggagagtgtatgtgtgccacatttccttgatccagtctatcattttggacatttggtcaacaagaagaaaatttagtcctgaaaaataattttttataaaggctgacattttggcccagcattgttgttgttattgactttattttttttttacagcagttttaggtccacagcaaaattaagcagaaagtacagagaggtctaatgtgttttggttattttaaaaattaatagactacttgttacataaaacaaagtaggttttcttgcttgttttgtctttttttttcagtaacactctaaagggtaaatttattttgtctgcaaatcaagtgtgcatacatgttgccttgttttctcttcacttcaaacatgtaaaatttcatctagaacttaattttgtaagtatttgaggaataattcatacctttattatagcagataaaagcctagataggacatttaaaaaataatttctaaattgtaccgcaattattttaatttcaaaaagctttcctttatcatattcttatcttttatttttatgttttaatgttttaataatttcaacttttagatttgagggaacatgtgcaggtttgtaacatgactatatttcatgatgctgagattaggggtatgaaagatccatcacccaggtgctcagcatacaccccatagggtgttttcagcccctgcttgcctctccctctcctccctctagtaatccccaggtctgttgttcccctcttacctatttatgaacccaacgtttagctccacacacaagtgagaatatgtggtatttgattatctgttcctaagttaattcacttaggatatggccccgacctatattcatgttattgtaaaaaaaaataagtaattttgatttttttatggctggcattccatggtatatatttaccaaattttatttatccaatccaccattgataggcatgcaggctgattttatgtctttgctattgtgaatagtgctgttattaatatgtgagtacatgtgtctttttggtaaaaaaaaaaaaaa

SEQ ID NO: 93830 - DNA, 518 bp, Homo sapiens
ttagatattagttattttactctgttacattgctaacagggtaaaacaggttaaccataatttatgtagaaaatatagaatgtgagaaaataaataacgcaatgagaaatacaaagactaaacaaacattaaataaaaaataccaaacacatgcataagatacaaactcatacagtaatactcagccttgaaataatcttctaaacttatgaaaatagcaaaacataatacaaaagagaaaatctcaacactgttattgtaaagttgttttaaattttgtgtgctaaatcattgatattaatattataagtaactgtaagtcttctagcaggctagatattaggcaatatatagccagaaacaacttttttatacattaaaaaaaaaaaaattcagattgggtgtggtggctcacacctgtaattccagcaatttgggaagccaaaatgggaggattgcttgagcccaggaatttgagaacaacctggtcaacatactgcgagaccttgtctctattt

SEQ ID NO: 93831 - DNA, 1445 bp, Homo sapiens
aaaggggaaagtctttttcagtgttgcataacagttgatttccccaccattcccataccctaagtgaaaattcaactttgttctgattatcagaaattgattccttctcctatagattctttaaagaaacctctgatggtttaggcttactaactcaaggtgctcttaatatcagtgttaagctgtgtgttaagcctacttggctttaaaaaagtgttacacaggtgcatatggaaactttaacagctttcaagttttcagtccaaatctaacattttgcagactaatgtgataatttcagattaccaaagtagcccttttatagtgaggggcctttgtgtcttacaggctttttttgtggtggattgggtgtcctaaaattcacctaggtgtcttgtaagcctccccagtgcagcagcagcttgctcttgtgctatcgcagtgccgttaggtccctgagtttttaagtacttacttcaaccattcttctgtattggcagaccattgtcttgtgttgggggctcagaaaatactttcatccttaaagtgcctaacccagtggcatacacatagtaggtactaaataaatgtttactgatttcttaaaaaattgttaactgattgatgaaactttttcagtcattggaatttgatttcataaagcctcctatgtagacttcaaaataatagtatttccagagcaggagtcaaattataaattataacaccacaaccacagaaataatagccccatacttgttattcatgaactgtacatgttgatatctcatttacagttatttgcatttaggcatgtcagatagtagagcagaggtaaatgtcagcattttttctagtctaatattttttctttgaaaatgaatctttttaaattttaagatattaactatgctctggaaattcatgttagagaaggcaaactgctagcaatttagcaaaattaaatcataaaattagtttctttgtattatctcaagatgcaatttaattcattacaaaatttcttattaaaactgtaagtcagcatatctttaagtgaatttcaacaagaaattcattgggggatgcttttatagtcctacagcatttagtaaataccagtttatcagtgtgggtgggagattgataactaattgcatttttaggttaagcagtatgtactttgcgttaaagtgtatcctgcatgtgttctatggaacaatatgtggactgttagtattgtatgagaaaagagttccgtggtctggtaagtttttgggaaatacaggttgaatatccctaatcagaaaatgagaaatgttccaaagtctgttttgagtgctgacatgatgctcaaaggaagtgctcaatggagcatttcagagtttggattttcagattagggatgctgaactggtaaatataatgcagatattccaaaagcc

SEQ ID NO: 93832 - DNA, 202 bp, Homo sapiens
agggtatgccactaaaatgcgaaaaaatgaatttatgtagaattctacctagtctcatccttaaggcatttgctttctgagaaaggaaaaaagaaaaatactggttattttggttgaattggggactagacactgctacgacactgtcagaaattaagtatgtttgggaattatttcaaaatataactagggggaacggggt

SEQ ID NO: 93833 - DNA, 227 bp, Homo sapiens
cctcccaaagtgctgggattacaggcctgagccactacacctggcctgtttatggaatgtaatattgattttctcggctgtagtttagcctgctccttcatgaagcagcgtcttccttctgtctttgcctgttttttgttagcacacagattgagaagtgacatcatcagtgcaattaagtacctacaggggtaagcacattgagtcatacgccgtggagggaatat

SEQ ID NO: 93834 - DNA, 383 bp, Homo sapiens
ggggcctagtgcagtggtcatcatcatctgacgggtagtgtggaaacttcatccagctatgagatgacgagggcctaggacgggtggcttgtggaaaggaaaagatattaaacgtgtgagaaaaaaacaggatccagtgacttagatgggtacaggagccaaaagtgaggaaatcctctaagatgagtcctacaagcttagttaaatgccatttgttattgctagtactgcaaaaggtaggaaaggaaggtgtgcagacaagtgagggagctagggtggacagtctctgttacattgacattctactggagtctaagctccacgaggaaaagaacttcacctgtcttattcaggtcagggctttgtacagtgcctagtcaaaa

SEQ ID NO: 93835 - DNA, 179 bp, Homo sapiens
  misc_feature (150)..(150): n is a, c, g, or t
ccaccacttattgtcttcaaacattattgcactttaactttcttaatttgacaaagcattcaagaaacatctgcagactagttttaacagacaaataacacctgtaagcagacatgactgtcctaaattgtttattaagaaagttaaagngcaataatgtttgaagacaataagtggtg

SEQ ID NO: 93836 - DNA, 207 bp, Homo sapiens
taacctggtaagagtgcggtacaaaaaaagaatatgaagagccgtattgacaactattctcacagatgtatatacgtacagcaaacagcccaaattaaaggagaattcaaataaatacattccgtgttcagactgctgtggataattattgatcctgcagttggagcattgtttacctcacactgaacagcaacttagagaaccccc

SEQ ID NO: 93837 - DNA, 409 bp, Homo sapiens
cctccaccctgccccacaaggctccgtactcccacctgcctgggcagccctcacacccatgctccctcctttaggcaggcccagaaaggtgccccttcctgagggtgttgggggatggcggcagagagacagctggtattaggagcttccccatcctaatgtgcaggaccaagttgcccgctctgccagccaggggctccagccatgctggcacaggcatctcagaggtgtgagatgaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcag

SEQ ID NO: 93838 - DNA, 453 bp, Homo sapiens
acttggtccagatgattgtattttaaaaggtatgttaaaataactttgtactgtggcagacatcagtgggtcatttggcatcagtgttaaagtacccttgccaagagaagatggcacagtcaaagcagacctaccatgaataattttaatggcctttgcatcatcagtggaaagtaattgaatgatcattgccaatttcaggtagcactacatatcttttattaacaaaatttttctttattgagacaaatcctgtaagtgaaaagacctgaggttgcccagcaggattcatttccaagtttctttggcctgagttcatatcaagaaatacctcctgggggtgatgaaataatctgcacaccaaacccctgcaacatccaatttgcttatataacaaatctgcacatatatccctggacctaaattaaaataataaataaattcaaaagtttc

SEQ ID NO: 93839 - DNA, 504 bp, Homo sapiens
ggaaccaatctcccacagatactgggtactgagggatgcgactgtatgcactttgtggtccatggggcctgtaacaaggaatgggaaatacctaccttcaacgttgcctagaaaccagatttttattaaatgtgtttgttgccaagtcttgtttctatttcctagacatacctgcagcttctcctatgtgctaccagtgcatttgatatggtttggccctgtgtccccatcatatctcatcttgaattataatgcccacctgttgagggagggacccgtaatccaagtgattggattatgggagtggttcccccatgctgttcttgtgaaacctgatggttttataaatggtagtttttcctgcgctcacactgtctctctgtcctgctgccttgtgaagaaggtgtctgcttcccctttaccttccgccatgattgtaagtttcctgaggcctccccagtcatgtggaactgtgagtcaattaaacctctttcctttataaat

SEQ ID NO: 93840 - DNA, 538 bp, Homo sapiens
ctggtaaggaattatgtgctctactacccaaatgtcttgtcctgatggcaggaccttcattcccttctgaacatttgcttctaaatgttatcaaggtttttagaaacagaagtgaaataacaaaatggagaaactatgcatatatgcatctattcagcatccagacacctaaatgtctattaggcactctttccagatgcattttctgccttgggggagtgcttcataaatctagatagagtgtgaatgtcagtggatggattaccggcaatttttctatgatctcatctcacgtggtcctctaatggccaaaataatcaggagcagttttccacatttaacaataactctttttaagttctgaaacttaatggcattagctgaggcagaactgttcaaggaaaccaaaggaaacatcaattatgacacacagcaggtgctgacagtgaatgttgtgctagaggccataaatctatgtcttaacattggtagaatatgatgtgttcagtaagaccattcttactgccttctgcctgta

SEQ ID NO: 93841 - DNA, 193 bp, Homo sapiens
cctgatcgcatgagcccagtaattcaaggctgtggtgagctatgatcaagccactgcactccagcctgggcagcagagcaagacctgtctcaaaaaatacatacatacataaattccaccctttttgatagcatgttatgaggctcaccaaggtctatcctctggcagtatccctggcctgttctccccatct

SEQ ID NO: 93842 - DNA, 509 bp, Homo sapiens
aatcgggatacacaaacacaaacaccttgctgagctctctggcctccccttcctctctcctcctcccctccccaacaccctctttatctttgtacccttccccagctgtggaaaacattcggttaccagaatggaaaagattcttggggcagcatctggagcctgaggcctcagactgcctctcatacctgcctgaaatgggctcacagatgtgatgtgtggtaggggtggggatctgtggggcgatgcaagtggcctcttgagagctccattataggtggctggagctagaataagggcttccttcctcaaagacagctttccaaattgaggcattaatggggatcaatggaaatgaaattgccttgtgatcacccatctccaagagcaggggagagagggggtagtgtgagaatgtagaattgaaaatgagtagaactcactcactaccttgtctctaaaggtatcttgccctcttcatcttttccctatttaaaagtcaaaaatgc

SEQ ID NO: 93843 - DNA, 499 bp, Homo sapiens
ctctagggatgaggaaatattctgctagatgaccttaaaaaatgtttcttccagagacttttgcctcatttacaatgtctttttttgtcctataagcctctctttgattttataaactgacataatttcttgttgttatgagtgtacactgctctagtcgttcaataaacccatcacacattttcatcatattgtcaattggcacctttttctttttcagtgttaacaatgccattatcatcactattatcacaatcatcttaattcagagctcttttggctatttcatcattggtcaatgaaaacacctggagtcttattatcgatgttaataacctctttgatatccacttcttccagcttactgatagactctgaaggtatatttttttgcttacgtaatgaggtcagacataattttttctcacttgacatacagaatccttcagtcactaccttgttcatcatcactgaacatagttgcaggccagaggttgtg

SEQ ID NO: 93844 - DNA, 461 bp, Homo sapiens
tagacggagtcttgctctgtcccccaggctagagtgcagcggtgcgatctcagctcactgcaagctctgcctcccagtttcatgccattctcctgcctcagcctcccgagtaactcgaactacaggtgcccgccaccacgccccactatttttttgtatttttagtagagacagggtttcactatgttagccaggatggtctcgatctcctgacctcgtgatccacccacctcagcctcccaaagtactggaattacaggcgtgagcaaccgcactcggcctccatttcttaatattgcagagaagcacctcatttcccaggcttactagtctaacttagccacatgtgttttaagaagcagcagtaagtaacatccctgtcagttgttcttttcagcagaattcagttggccaagcaggtaaatctgtaagccgaatggtttgtgttcacttggtcactg

SEQ ID NO: 93845 - DNA, 691 bp, Homo sapiens
ttcaacttggggtctcctccttgcagcctctctctggtggcgtcattgcctctccactgatccttcccttgggcggtgctgtcaaccggtgccgctgcctgtcagcccatgggcgaggtgagtcacaggcactgtggggttcttggagtcttaggcctgctcacttgaggcattcttcccctattcgttgagtgttctcagagggaggggacggagctgctcaaccctgctcttgtggctgtcaaggtgtcctgcattatcccacacgcccaactcctgggatcttacagggaggctgctgatgtccaccttcctgcgcttccatccatcaggtgcctgcccttccttggctgcagccggccgtgaggagttttcctccatagatagggttcaagtaccgcccaactgtcacctcatggtcatctgacattcctggtggtggtggggggacccccgggtactatgctcacgtcagaccaagtacctcaagtgataggaacgtctgacaggattgcacatgtggcagaagagcatccgagaagattgaagctttggcagaagaaacacctgccagatcagatgtgaatgtgtggcagaaggcccatctgggaagattgcacattgggtagtaggaagacctaagagcactggacagcagaaggagtgcctctggagattgcccggtgggcgg

SEQ ID NO: 93846 - DNA, 385 bp, Homo sapiens
taatcagattgttttcctgttaactgagttttaagagccctttgtaaatcttggatagcagtccttcatgagataggtctcttgcaaatagtttctcccaggctgcagcttttctcattatattaaaaatgtttttcaaagagcagagggttttgttttgttttgttttttgagatggagtctcgctctgtcgcccagtctggagtgcagtggcgtgatctcggctcactgcaagctccgcctcccgggttcacgccattctcctgcctcagcctcctgagtagctgggactacaggcaccaccacgcctggcctagcagaggggtttttttattattattttaataaagtcaagcttgtaagtttctttcatggatcatgcctt

SEQ ID NO: 93847 - DNA, 272 bp, Homo sapiens
aaaggactggggagaaaaaccctcttaatacactattgtcctcagcagtttcctctttaaaaagcaagggcctgttgggctccttgaaggggaaaagttaagaagatggcaatgccagtcaccagcctggtacaggaacaacggcaccattcacagcaagacccttgtcctctgtttcaggggtgaccttgtacttgtcacccatgctggagtgtggtggtctgatcacagcacaccgcagcctcgaactcctgggcacacattatggatcc

SEQ ID NO: 93848 - DNA, 264 bp, Homo sapiens
aagcatttcctgatatcacaaatgagagctccgtgttaatgacttctacagccttgcccagtttcatctcttctgcttgcactgactgtcatcaccccctactctgcccgtcgaagacccactcaggccctccatcccaagcccctctccagttctgtagctctcaaaaaccttctgtcttcccaattctcggggcatttatacactacattatatacgttgatgtccagcatgagctaccttgtgaaattcactaatgctttt

SEQ ID NO: 93849 - DNA, 754 bp, Homo sapiens
taggcatatattaccccattttgctcaggaatggtctgagctgggcacaggtagggaatagacaaagggggaaactcaaaaagctgttgtctgtggaagatgaaggtgaagtggttgtcaagcctgtttgattgaaaatgatgcttcagggattcacaacatgtcaggtttaagggggaggccctctaaaaaatactgggtctccctgagcctaagcgaaaatcttacagaaatctacaggtatcattcctaggtgtttgtcctaaagaaataaccagagatatggccaaagatacgcatgccctttgagtaatgttgtgttgttccatgttacttcattaaaacattgatgagaaaaaaatggattcccagacgcagccactgtctgtatggagtttgcacattctccctatgtctgtgtgggttttctccaggtactttggtttcctcccatatctcaaagatgtgcatgttaggttaattgctgtttttaagttgtcccagtctgagtgagtgtgtgtgtgtgtgccctctgatgtaaaggcattctggccatgattggtttctgcctcaggttctgtgctgctagaatagactccagcctcttgagaccctgacttagaataagtggattgaaaagagatgaatgaatgaatacaaatgatcatgaaataaaaatttataaaatatatgataatcatacaattgcatgacaataaaaagtatgggacaaaatctttcagagggcctacca

SEQ ID NO: 93850 - DNA, 384 bp, Homo sapiens
tatgaattcacactagtaggtgaatcatggagaacctcttaaccctcttaatgtcttctcgtgttaaaacgaattggttgtgagacttgagagtccttgtggcagtatgggttagggatgaacacggtggctaaggattcagaattcacacacacattagtgggactcttaggctcttcactgcacctgcttccagaacactggcagtcagttaggaaacgatcctactctggaaaaaaatgggatggtcacagagaagaaactttcaggttcagacactgggagactcccctcagtaaataagctgattatctgccagatcgcctctgagaataagccacattcatgcacacagaaccccccaccagttttttgtgcatcata

SEQ ID NO: 93851 - DNA, 226 bp, Homo sapiens
atgagaaatagccatatgttccatttcagaatgtgtgttgctgattaaaagccaaatgggagttataaaatttgggaaagtgaaggaaaataaatgcaactattaattaggatctagttatgatgctgttgtgaagaataatacatctttagcttaaataatattcaatatcttgattatatgtaccattaggggaaaatagtgactaagttgttgttagtctata

SEQ ID NO: 93852 - DNA, 327 bp, Homo sapiens
gtttcatgggcccagtgcagggacttgctgctctgtgcagtctcaggacttggttccctgtgtcccaatcatggctaaagggccaatgtacagctcaggccatggcttcagagggtaaaggccccaagccttggcagcttacatgaggcgtcgggcctgcgggtgcacagaagtcaagaattgaggtttgggaatctacgcctaaatttcagaggatgcatggaaacgcgtgggtgttcaggcacaaatttgtgacagggacggagccctcatggggaacctctgctagggcagtgactgcagaagggaaatgcggggtcagagccc

SEQ ID NO: 93853 - DNA, 828 bp, Homo sapiens
tcccgagtagctgaggtcacaggcacctgtcaccatgcccagctatttttgtatttttagtagagacggagtttcaccatgttggccaggcttggtcttgaactcatgacctcaggtgatccacctgcctcggtctcctagagtgctgggattacagatgtgagccaccgtgtccagtctgagaaggggctttgagagaaaagccaccttggccagtaccaggcaggaagggactcaacggggctccagcccagctacctgtaggagctgagccaggcagcctcctcgagtacctgtggccccagggtccgcattccacaccttccgctgtatgtctcagtcctcgcgctccaagaccaggtggctgaccgtttggttggctcaaatccggttgtcttgactgtcgttttgtgagcacctgtgtgctaggcggcatcctaagtgctttaaggaagtgcttctggaactatctgtgaggaaggactgggttggttttgttgttttgttttgtttttttgttgcccatactgaagtgtgatgtttccatcacagctcactgtagcctcaacctcttgggctcaaatagttctctcacctcagcctcctgggtagctggaaccacaggtgtgagccacaaagcctggctaatttttgagttttttgtagacaagggatctcactctgttgtccaggaggatcccttgagcccaggaggttgaggctgcagtgagccatgatcatgccactgcattccaacctgggtaacagagcaaaaccctgtctctaaaaacaacaacaaaaaatacaaaagcagaaagtgcatctgaa

SEQ ID NO: 93854 - DNA, 846 bp, Homo sapiens
acgttgacacttcagccttctaagtagctgggaccataggtgcacgccaccacacctggttaagttttttttaaaaaaatttcttacaaagttttgctatatgcccaggttggtcttgaactccagggctcaaaggatcctctcacctcggtctcctagagtgctgggattacagatgtgagccaccgtgtccagtctgagaaggggctttgagagaaaagccaccttggccagtaccaggcaggaagggactcaacggggctccagcccagctacctgtaggagctgagccaggcagcctcctcgagtacctgtggccccagggtccgcattccacaccttccgctgtatgtctcagtcctcgcgctccaagaccaggtggctgaccgtttggttggctcaaatccggttgtcttgactgtcgttttgtgagcacctgtgtgctaggcggcatcctaagtgctttaaggaagtgcttctggaactatctgtgaggaaggactgggttggttttgttgttttgttttgtttttttgttgcccatactgaagtgtgatgtttccatcacagctcactgtagcctcaacctcttgggctcaaatagttctctcacctcagcctcctgggtagctggaaccacaggtgtgagccacaaagcctggctaatttttgagttttttgtagacaagggatctcactctgttgtccaggaggatcccttgagcccaggaggttgaggctgcagtgagccatgatcatgccactgcattccaacctgggtaacagagcaaaaccctgtctctaaaaacaacaacaaaaaatacaaaagcagaaagtgcatctgaa

SEQ ID NO: 93855 - DNA, 789 bp, Homo sapiens
ttcaggtttgattaccaccacctaagacacggccactttttaaaatatttgtagtttaaattaataacaggctcagtaagaccatcaaaaatacaagtctcaagaggtacctggagagtgaacaaactttcctcaaactgatttcatcccatttgcacctgatgtctgatacacagcagctactcggtaagcattagcttgccttattactcccgcttgggctctggtattccctgggcaggggtgcagtgacctgaggggtgggagatccacatgtgggggaaggaagacacctgcgaacagcaggctatggggcacggggctagtgcagagggtccctggacctggggaagtgatactaatgtgcctgccatgggcttgcccctgggccgagaccctgaaggaaatcgctatttcagccaactgcattgcctgcacagggtcatttcgtctatgccagctacccagcatgcttgaaagccacccccagaaaataatttctcagagcatcatctgggtttaatattccggcggcaggtataagtgacatcattgccttttcagccctgagaggaagagtaattttcttttaggaaaaaagaagtgaactatgattacaggcagatctttgaggtggaggaaggaaagtgaggagttttaagcaatgttttctgctctcattcttggaacagctttccctcttgcccttcctttctcacttagcttatttagtttggtccgttcagggttccgtttcctaagggaggtttggtgggagatctggaagaa

SEQ ID NO: 93856 - DNA, 203 bp, Homo sapiens
taggggctgggtattcaaaaggtagatgagataaaaaatatagtaggagggagacctaaagataattgtaatgtaatgtacttaatgctataataaaggtacatattggatacaatggcagcaatattggtcctctgaaaacaatatagttcacaggaaggtcttctactggggcatttggccccaaaacctacttctctgag

SEQ ID NO: 93857 - DNA, 539 bp, Homo sapiens
atggctctggaagctcattcctgattcttcctatctagagtcaggatagacatattctgtccaatggagacatgttgtaggacactcccaactgacttaggaaaggcagtgaagaggagctggaatggaggcagaggcagatatttattgagaatcatctattagacccaagaaggatcaatttaaggtccagagcaaggggaaatgggtcaaaatgtaaagttgggatgttcaaactttgtaaagacctactggcactagactgagaagtcaaaggaagctcaggggagaaaaaaggcattgtagttaatctggtgtatttaatattatttctggtgctttaggcaaataggaggcaacaccatggaggtaattattcctttcctcaagagctgggggcagtcatggtgatgatgatggagcagcagctgaagaaacttcttaagagagaatggggagacagatgtataggaagtgcttggatagttccattttgctgggtgttattcctaatgggagtgaggcaagaagcctagatc

SEQ ID NO: 93858 - DNA, 365 bp, Homo sapiens
atagacacggtctcatcatgttgcccaggttgttttttttgaggcattcttgctttgtcacccaggctggagggcagtgacgtgatcttggttctcagctcactgcaacttctacctcctgtgttcaagcagttctcctgcctcagcctcctgagtagctgggattacaggcatgagccaccacgcccagctaatttttgtatttttagtagagacagggtttcatcatgttggccagtctggtcttgaactcctgacctcaggtgatttgcccacctcggcctcccagagtgttgggattgcaggcatgagccactgtacccggcctcccaggctgtatttttaataaaagtccaaatgtgtca

SEQ ID NO: 93859 - DNA, 2042 bp, Homo sapiens
  misc_feature (2038)..(2038): n is a, c, g, or t
ggttagcctttgtggcttgggcatccagcctttcagagatatgaaaccacacacgtcttcagagtgaacagctgctcaccccgatgtgctcaaggggtgcaggatgtggacacatcctactgaatgagccagacaacgtaactggatctgtccagaacaccacgatgggtgacattgccatctgcagcagtgctgtacttcctcccgccaatttgtaaagtgcagacaggatgctggatcaactggctgctgctgaggccagtgacctctagggcgtattcccacgttcctttgcagtagctgctcacctttgtaagcatgtgagttattcgtgctgtctgttgtgatcctaaggaatccaatggtcaggaccagaacttctgaagtacagcccagcattgccgtctggcatccccagaaagcagattttgagattggcatgatggccgttaagcagggcgttctctctggagcaatgtctagccggggtcggagtggggagagagagaggggggctgctgagaatatcacagagagatggcagcctttctgcagcataggcctaagtgcacactcacctggctatcactgagaggactctctgttcaacagggccactcagggcttcccctgcatggagatctgagtgtccagggaggggacgtggtgagcatttctctggtcaaagtgtgcaaagcaaaatctgccccattcctgccaaagtggttgacatggaggaaaggggagtgccagttctgtaggctgaggtggtggctgttagaactgctcctaggctagttggtgttctggaaggttcccctctatgtgagatgaaagagcatatctttaagagctgcaactttgaagctctaatatagaatgcttttggtggcaagcattacttcggaaagggcttgaagacccctgaagatccttggtggcctaggcagttcctttattgccagggctgtgcaggactaagcttcaacagcgccaccatgtgacaagaagcaattgcagtggtgcattgagggttttcttttgcactgagaactcaagtcccactttcacccttggacctggtaaatctttggggttcatggacaattctgaggaggagatacttaagagagtgatgttagaatttgatgttttggtttattgtatcagaaaataaaagaaattggatttatagctcagtttgtggttcatatcaatttaaatagctttgaaatgctgataggaccatcacggttttttggttgctgaaatcccataactaaagcaatgcctcaataagcttttaatccacagcccccatgcccaggtctataacaaagtttttatatgcctatggggaaaaacaattatgaggcaaacatttataaagttaaatttattacgtttctactcctattttttattctgctggtgtattgttatatattttcctacatatttaaacattttcttcctcttataaaatgttagtgattttaaatgatggtgtgtccggaattggttccttctggtgggttcagtcttgctgacttcaagaatgaagccacagatgctcacagtgagtgttacagctcttaaagatggtgtgtccaaagtttgttccctcagatgttcagatgtctccagagtttcttccttctggtgggttcgtggtcttgctgacttcaggagtgaagccgcagacctttgcagtgagtgttacagctcttaaaggtggtgcgtccagagttgtttcttcctcccagtgggattatggtctcgtgcagaccttgcattgagtgttacagctcttaaagggggcacggacctgaccatcctggctaaaatacagtgaaaccccatctccactaaaattacaaatattagcccggagtggtggcaggtgcccatagtcccagctactccggaggctgagacaggagaatagtgtgaacccgggacgcggagcttgtagtgaacagagattgcgtcactgcactccagcctgggcgacagagcgagactccatctcaaaaancaag

SEQ ID NO: 93860 - DNA, 262 bp, Homo sapiens
ctgtgttgtccaggctggtcttgaactcctgggctcagtgatcctccagcctcagcctcctaaagtgctgggattacaggcatataggcatgagccacggtgaagccaacccttgatctctttcttgcagataggaactgccatttgttttagtttcctggagcctactgtaacaagttcatataaactaagcagaaaattactcttggcgctggaggcacttaagaatcctaccttgcctcttcctgtcttctggtggttg

SEQ ID NO: 93861 - DNA, 692 bp, Homo sapiens
aagtgccagagtttgggactcagaataaatgagttcttaacaatttaacaaaaatgagtttaaccaagaactgtgtacaactgttcaacataagacatgtatcttttattcatctgatgttcatagtggttgctggctggcatatgccaggcatgcagtaaatagtgaaggagaagcaggcagggagtgttagagaaaaccaggcgggccacaagcaagggctagaggattccatgctgtccttcctctcatcctcattagtaatgggtttttaaaaggtcgtaaaggccaggcacagtggctcatgcctgtaatcatagcactttgggaggccgaggcaaggggatcagttcagcccaagagttcaagaccagcctggacaacatggagaaaccctgtctctacaaaacatataaaacttagatgagtgaagtgccatgtgcctgtagtcccagcttctcaggaggttgaggcgggaggattgcttaaacccaggaagttgtggctgcagtgagctaagactgcaccactacactacaacctgggctatagagccagaccctgtctcaaaaaacaacaaaaatgttcgtcagcatatggtgactcaaaaagcctggttgctcttggtaagaatcttcaaggaaagatgcgaaagagacgtgttgggagttctgagctgttttctttcaggg

SEQ ID NO: 93862 - DNA, 386 bp, Homo sapiens
gagccagaagcattcagagccatcagcaaagcagagtctgcctctctgcagggagctgtctgtggagctccctgtgtgccctgatggtaggattcaatcgctccacagaaacctggaattctccctgttgtcctgaactgtgagaagccaagtcctgtgttttagatacaataccatctgaattctgctctcactgctggcccatgttctgtggcttcagccgagtaattccactctccagggctctttgtcatccatctgtgagagccagtccgggcagagaaggagaggagcagggcaagctgagaatgcagcccatgatgccgccccgattatggtgtttcctcactggacacgtggatgaagcgtgctcgggttttgacatc

SEQ ID NO: 93863 - DNA, 399 bp, Homo sapiens
tttttgtagaaattgccaggaactgattttctgcccttccttcctaacagacaagccttccagccctccctgacacagctcttccctatctcctactctctggtcatcaagcttttagagatgccctggccttctctagttgccccagctgtattttttcttcttgggaatgcgttgattccagagcctgactgggaataaatctcagctcctccatttagcagttatgggattcaagtactcttactcccagggactcagtttctgcacctgtaaaatggagatttaccacctttcgttccagcattactgatattgtttggctctgtgtccctacccaaatcccatctcgaaaattaatccctatagtccccacctgttgagggtcctggtgggagg

SEQ ID NO: 93864 - DNA, 461 bp, Homo sapiens
gtgtctaactggcccacgtttacctcttcgggcaaatccatggggacagataaagtcggaaaatgacacaaggcatagaatcctctatacacgcctaaccattagttgaacaaagccacttggttcaaccagtaagtcctctcaataacataaaaaggaactatgactttgttacggtttttgaaacggatgttgcagatatgtttcttgaagtagcacttctggaggttaagttttactattcagcattgacgaagcaaggggcaatgtctccacccattaacttagcaatgatagttccattgcaacagttcttttgagtgatttggctgtttaccctagcatcattcaagcctgcttatctagctctctgaaatattctgtaagctacctaaaagtttaaataaagtatctgtctgttaaactaactagggttggtttccatttgcaattaagaatac

SEQ ID NO: 93865 - DNA, 414 bp, Homo sapiens
caaaacacatacacccatccattcttccaacaaatattttattgagcacttactatgccaaatactattctagaaactgagggcctagcaggtaaaagaagacacaacttctctattctcatggagctcacatactagtaggtctttacagtacagagctatgaagaaatatcagaaagattaattcaaaatttatttacattcccatgaggaaaaccaataggtctctgtatatgaacattttaaagtgtcttgataccttctagcaggaatgataataaaactatttaacaatccattatcaatagactccctgtccaatcagaagaggccagcagtaccaagcatcctggctaaaaatccagcctcgactactgcccaggtctttactagaaaaggtgaaccaattacaca

SEQ ID NO: 93866 - DNA, 568 bp, Homo sapiens
cagcattcaactttccagctaagaaaggacaaaaccaagcagccacatggagcaaagcgtagggagtgaaagaactgtattctccgtccccactgcaggcttcctgccatgagctgtggaaaacaggaagacctaatgctcggttaattctggagtttggaagcgcatctttacatgtagattctaatcacagaattaaaattattttgcagtataaagtgaccctaagtctgtctcttgactacatataggcagatatggcatgggaactctctcagaagatttgttcagtgtctgagaaagattactaaatcagatatttttttaaaggtggtaggaaaacaaaataaaattatgctttcttatgtctgcaattatgtctgttcaacttactgatggtatttatgtatttatatttgagacaggctcttactctgtcacccaggctggagtgcaggggcacaatcacagctcactgcagcctcgacctccctggctcaagcaatcctcccactgctaggaccacaggtgcactctaccacacctggctaatttttgaatttttttg

SEQ ID NO: 93867 - DNA, 195 bp, Homo sapiens
tataataggaaaacagtaaatacctaccttagggagttttcctgaagcctgagaaaatatatttaaagtacttgaaacaagtcttggcacacaggacttaaatgctgctgctgctgtctgctcacaggtttgtggtgaggattcagtggcagaattgtggagagtgcttagtgcacgcctaggtttgggcatgtg

SEQ ID NO: 93868 - DNA, 682 bp, Homo sapiens
cggcacgagggtttgcatgctttttaaactaattgtcgttcattttcacttatctttaagccagtaggtcactggctgtttataaaattcatcagaggaaacattctcagacatttacccaactggcaagtcgtgctaacccgaagacccaaagtacccctttatgcaaaataggatccaaagctaaggctgggtaagaatagttgtgcagggagggagcacgagatgggcagagctggttcctaccactccattcacacagttcatcagttcattcccaagtatttattgtcacccccaaacatctctggagtactactgctcaatttttgtgtcgttatcaggagtataccttggctcttccttttttttctcctgcttccccccgcaccttgtggggaagcttcaggggagcgggggagggtgattcccagtggtggggaaaacattaatcaaggatacttgcatttagcctggagccccttcctcattatgctttagaatattcataggagttccatttgtattctggctgggtgatgagcaaaaaaaatatatagtagcaaatattctctcatcctttagagataaagaaatggtgttcatcaaatgtactgagaatagactagcatttgtggggcactcaataaatttaaattcatggtgacagtgaaaaaaaaat

SEQ ID NO: 93869 - DNA, 462 bp, Homo sapiens
cacaaagtcccaggtagaagggaggagctgtccccagcagcctggggtctctagccccggtccaccatcacagcacccttggagtgagtgtcagggagtgtgggatatttgcccaaatccagccaccacccctgtccgagtagagcccacacagtattggaaagagaaatatagccactgctttcactcctgggagtaggggtgccctggttgctttcaccagcctgcaagagtatagtcagggtgaggtgctggagaacatcaacaacgatctgggttcaaatcccagctttgccacttattagccatgttgctgtgtcaacttctctgagcttcagtttattccactgttgtgtaaagataatgcctcttagggctgttgtgagcattagcacagtgcctggcatatagtaaatactcaatatatggtagccatattataattgtaattgttactaccac

SEQ ID NO: 93870 - DNA, 453 bp, Homo sapiens
gattgaatcccaactcaccacccaggaacaggagaggccaggctcctagctgcaaagggtgagaacttcctgaggctccatcccctcctcccagtgcacaggctggtgggagactctccagggaccttcccccttatcttcctcctgcatcgatcattactatgttccagacactgcatcaacaactttatatgcagctttctttgccaaagaagtctcaccaaaaaaacttcttcgaaagtatctgaacacacaaactcaggtgtctacatctcacagcagggacacatggtgcatcctccacggaagaagccgtgctggctaagtgtgtccatttctaccccaactgccctatgaacagaaaggatttctaaaaaaggaaacagagaaatactgttggaaatgtatttaaaacaaatcatcatctttccgtatttcctttttttttctttt

SEQ ID NO: 93871 - DNA, 602 bp, Homo sapiens
gctcaagacgtcctggtgctcacgtacaaaggcaggtggaagacatccagagggaggaggaagcagcagagtgtgttcacagagaagagaaaatgcagtagactacggcgagagtaaggaagaccagactagcaggacagggctgggcaaagtggctcacgcctgtaatcccagcactttgggagaccaaggtgggaggattgcttgagcccaggaagtcaagttgacaatgagctataattgtgccactacactccagactgggtgacagagcaagaccctgtctctgaaataaaataaaaatttaaaaagaatagcaaggtggtttctttatctcagttggtactgagaagtgacaaaagccacagaaattgaaaggtatgtgaggggacactgactacaacaattagaggaatttttcaaactcaagtcttcgggcctcagtttcctcagctaacaaatactgtcttggcaataaacaggggctctgtcgttgtcccctccagttctgaagttctatgcatctatgatttgaccatcttagcattcccagtggaatacaggtgtggacatctgtaaatgtacaaacacacaaagaacag

SEQ ID NO: 93872 - DNA, 274 bp, Homo sapiens
gtcagaaagagatagagagagtattaagctgtatgcaatttcattacctacaggttcaaagatccaccaatgaatagtaccaacactgcaaaaatcctgtgttgcccttttataactacatccagcttcgagaccctcttgagaccctaagccctatacctaactccaccaaccactagtctgtcctctgttcctaacattttgtcatctcaaaatgttatatgtgtggaattatacagtatgcactctcttatgatcaaattttttattcacc

SEQ ID NO: 93873 - DNA, 308 bp, Homo sapiens
gctattttttcctcagaacgtacatggtgaccagccccatgagtaaattttaaaataatttttctgtacctatcattatgtagaggtgatgtatataataatataattttaagaagtgacagaggctgcttttcaattttgttaaattcttagaaatacaacagtttgagataaggttactttttcattatagtactggcctttggattcctttccatgggtgattcagatgatattttagtacagtacagaattcgacagtaattttgtagttatcaggtagataactaataccttcctgggaactt

SEQ ID NO: 93874 - DNA, 846 bp, Homo sapiens
agcgggctttcctgtcacagccacaggccttgtttcaggaatagaatgagatagtgagggattgttccaaataggccattgctgtgtctcacacaccctcacgctttggaagaataagggaaacgcacgtgaaaaattcctaattaattgaaaattgttttagtttttataaggaaaactaatatgagaatggtatttaggtcctaccaagaatataaaaatgccatctgtgttcatatcccctgctccgccctctggggcaagaccctcagattgtttgcccactgtcagaacctgagctgtcatgcgctgtgtccaaaatgcttcgctgtatattgaaagtttttagttctgtgtttcagtgtttataagcgcaggcaagactgttagcattttaaaatgtaatttaatttttaatttattattattattattattattttgagacagactctcgctgtagcccaggctggagtgcagtggcgcgatcttggttcactgcaacctctgcctcccgggtcccggttcaagctattctcctgcctcagcctccctcccaagtggctgggattgcaggcacataccaccatgcccagctaattttggtatttttagtacagacgggttttcaccgtgttggccactatggtctcgaactcctgaactcgtgatctgcccacctcagcctcccaaagtgctgggattgtaggcgtgagccaccatgcccggcctattttttattattttaaatctattatttacgtatttatgagacagggactcactttgtcacccaggttggagtatagtggcatgatctcagctcactgcagcctccacctccca

SEQ ID NO: 93875 - DNA, 457 bp, Homo sapiens
tcaatattcaatgttttatcaatgacttggataaagacatataaagtctgcttaccaaattgtgaaagcaaagagttttgggggatagcagataaactagggttttatccccatccccaaggtctaaaaagaggaggatctcttagctgaactgacaactcaaatggtcaaatgcatgactagaattccttctcttggaccccaacagcaggtgaggtttgggagaagattttgcttcccaactacaaatatgaaaaggctgaaggactgcagtgaacggcaggcccagaacgaggctcccagtgaaagtgaaggctgtgagtgtgtcacccacaatggtggggaggtggtcctgtctctatcactcagggtggtggccagcaggcaccacagagagagcccaatgccagggactgctcactggggactctgagcacagggaacttctgtctgatgg

SEQ ID NO: 93876 - DNA, 708 bp, Homo sapiens
agcgggcagctctgggagtcgatgacagtgtcccattgagattatgctgatggttgcatagctgtagaaatgaatggcaacccttagaaccatgtgcgcttgaagattagcgtgcccagtgtgcatcgcagggtgtgtaactgcaccccagtgaagctgtgacaccaacagaaaagctcagcccgaaaaaggaggcgcagggctggaaggtgtgcagagcccggagaggtctcggactttgcatttccggtgccgacggagccgggccggaaggtgtgcagagcccggagaggtctcggactttgcatttccagtggacatggtgcagggccggaaggtgtgcagagcccggagaggctcagactttgcatttccggtgccgacggagccgggccggaaggtgtgcagagtccggagaagtctcggactttgcatttccagtggacatggtgcagggccggaaggtgtgcagagcccggagaggctcagactttgcatttccggtgccgacggagccgggccggaaggtgtgcagagtccggagaggtctcggactttgcatttccagtggacatggtgcagggccggaaggtgtgcagagcccggagaggctcagactttgcatttccggtgtcggacagagccgggccggaaggtgtgcagagtccggagaggtctccgactttgcatttctggtgcacatggtgc

SEQ ID NO: 93877 - DNA, 481 bp, Homo sapiens
ggccagtaggggttactcttggcattatgatctaagagtggtagattagagtttgaagacataatgagtggtatttttaaaaatagctattatcattgtgaatttaggtgcaatattcagaattcagaattggtgataacttgctttgagcactgtttcagcagcttttatcctattcatatgactgtcagacatattccagggaactattttacttagccttgttgattgtccctcattaaataaaatccacaggtcaaaattgtaaagtagccttttagttcaatttggcatctttttttcctgggtgatattctcagtcccaggggtttgaattccagacatccttgaaaacaaagccttatatgaatgtagtcagaactaactctttaaaaggcaaaagcacaaccacattcagttaccctaaagtaactgtagtcaggtggctcttcaattttagaaaataaattactttcaaaaa

SEQ ID NO: 93878 - DNA, 422 bp, Homo sapiens
agtaacattcaaatatgcaaatgattttctccatatggggtcagattccgtatttacaagaatcaacaatgacattaaccaagatcccaacacagctccccaagcccaagatcaggtattttattttcctagaactcccagttcagtacaaacttctgtatagagcaggtattcaacagtgattgacgacacttatctaatctggtaatcatctacatttgtatcactgccaccatcaccacccgctgccactctaccttcattaggtcttgccagtcattccaggagttaaacttaaaatttatctttaaaaaaaagctctatgcagaagacaagaattacacaacatttatttgtacttctcttctacgtgttctttacggagctcgtgtatgtcacccctcattaaatcacatacaccc

SEQ ID NO: 93879 - DNA, 583 bp, Homo sapiens
cagagaagacccgtattgagcctcgaaggacgagctctggggcctggtccccagtgagccaggggaacggccgcctgtccgggctccaaggtctcaggctcccagggctgctggtggccacgtggcaggcaagtcacctggagcttgatgccaattcacaggaaggtggccctgagggcgccagctaggagggcggccaccccaccgggggctctgggatggagcctcccctggactgcctgaggccgggcccatgaggagggaccccatagcccctctgccccagctccctgtgatacccgtgctggggaagcagccctggaagcatcgcttggccgggagcacctgcctgggctgccagactcgggcccagctgctccactgcctctgtggacctcggcgcccctcccatccccgccctccggctccttggctggggtctccaggcagctgtgagcaactccagagggtgcagctgtcccagctcccgagtgttcttggagggaaaatccagagctgtgttttccgtcagaatcggcggctgatggcgcaggggaggggtgggcagtccagactctgctct

SEQ ID NO: 93880 - DNA, 445 bp, Homo sapiens
ggcccaacaaaactcttgctggcttgagtgctgcccttgtactgccaattgaagtttaacatttgtctaaccctaaagactttcaaagtgaaattatttttaggttcttaacaaggtttttctatgccaaggtaaaattttcaagggcatatgaggtatttactgtctcactcagagttctgtttaagtgagcacatgggcatgcatgttggagaaagtgttgtgagctcttacagataaagtttgaaatgcaacctattttcaatagaaaaaagcctcttactctcagatagctcagaaaaacttagattttacaatccttttaagacttaagactcttaggtctgtggagtcaaaatgctacgtgatatttgtggtggatgaattactgaaaaacagaattcctcagcgaatcaagtgtctgatgcataataaaccaacctaa

SEQ ID NO: 93881 - DNA, 1038 bp, Homo sapiens
tttgtgcaaacaaagatcaggaaggaaatcaagataggaacaatgctttcaaccatcttgacttatttggcatttataattgacatataaattgacaacatctcataactacagaatatttatttttttacattgcacaaagattatccatgaaatggaacacatactatgactataaaactagtcttaattactttcataagaataaaatcacccagagtatattctctgaacacaatcttatcaaattacaaattagtaagattgagaaaactgcctaaatttttggaagtaaaataatacatttctaaataatctgtggcttgtcaaagaggatatcagaaggaaattagaaaataattttaaataaaataatactacaatgaatttttaaaattttcgagatgcaaccaaggcagtccttagagaaaaatatttagttttaaatgcctgtattataaaaagataaatatgtaaaaatcaaaggtgtaaacttttaacttaataataaaaagaaacaaatttaagttgaaaaaagtagaagaaaaaagcaaaggggtgaggaaatcgataacattattttcttggttttgtttcctatttgtttactatagagcataattgtgttagtcccttcttacattgccagaaataaacacctgaggttgggtaattcatgaagaaaagaagtttaactgactcagggttctgcaggctgtacaggaggtgtggtgctggcaattgcttctggtgagggcctcaggaagctaacaattatgggggaaggaaaggggggcccaggtatcacatggtgagagcagaagcacagagaaagtggggaagagtcgcacttctttaaacaaccagatctcatgtgaactgagtgagaactcactcattacagctaggatggcaccaagtcattgatgaaggatctgccccaccccccgaccaaaatacctctcaccaggcctcacctccaacgatggaggttacattttaacatgagatctggaggggacaaacatccaaactata

SEQ ID NO: 93882 - DNA, 377 bp, Homo sapiens
tgcagtttgaggtggaaggtgagggatattttaagtttcggactgtaggaaatcagtcagggtggtaggagaagctataaggaaagacgcaaaccttcttggaaggctgggaggttttgcaaagcttcagagagaataaagctgaaggcagctaattctcttaccccgaggctgagggcgaagagtaggtaacaaggtagtgtaaagaaatttatctagataagtttgtttacatatgtcctccagaaaccaacccttgatcagtgcaagactgctccctgcaaaggggggcgacaatgttcattactcacaaattgtgttggcttcaggcctttggcgttctgtctgtaccgaataaatacaagcggctccagctt

SEQ ID NO: 93883 - DNA, 146 bp, Homo sapiens
atgaataaaaccctatctaacaattactaataatcatatatttaatgccactggaggatttaaaaatcatatacttagatattttccaatagttgtacttctttattccttagtatcatttttaaaaatacgtgaaatgttccttt

SEQ ID NO: 93884 - DNA, 589 bp, Homo sapiens
agggagacagcgagagagcgaggggaattggtacatgtgattgtggaggctgacaagtccaaaatctgtaggatagggtagcagagacccagggaagaattgatcttgcagctggagtcccaagtctgctgacagaattccctcttcttcaggggaggtcagtcttttttctgttaatgccttcaactgattggacgaggtcctcccatattatggagggtaaactgctttactcaaagtctaccggaatctcatcaagaaataccttcacagaaatatctagaataatgtttgaccagatatctggagcataatctagccaagaaggcacataagattaaccgtcacacaaacataaagcattcttgcccaaaaagttgaacctgaatttaattagtcctccagaggtaactttcttttacatgaaatacagaaaaaataggaagaagttaaatgaaaaaacaaggagcagaagtgattaggcttcttctacgtgtcagcagcattttaaaaatgaagaaaaaggaggtggacttctctagatcaaaagagatttaagagacataataaccaaatgtgatatattgaa

SEQ ID NO: 93885 - DNA, 523 bp, Homo sapiens
ttagaggtggacacagagatgctgtgagagacagagacagagagacagtgaggagagacccagccagtggagagataacagaagtggcccagcagggccctgcgacagtggtggaatgatagaaagggtgtcccagagggccccggccccacgaaggtcagggccaggcctgtactccttgccccgaagtgtgcagaccccagaattggcccaaatgtccttcccacagaccctgtgacccctcataccaaatatccagaccccagatatccagatccaaattcgcagacccttagctttgaactccaactccaaatccagacttctggccccctcaagtccaaactcctatgctgatccccagtcccagatatccacacccccagtcctgactcccagccccagtcagctcccaacctcagatatctagatcttccgccccaagtgtccagtctcttggctttgagcccctaggtcccaaatatgcaagccctcagccctgacctctaaaccccactcagaa

SEQ ID NO: 93886 - DNA, 260 bp, Homo sapiens
cgaagaaagccacacaaaaaaatgtatacaccagcactttgggtcaaaaggccacaggatctttgagtctgacagtgaggtccagtactaaggtcatggagacccccactctgtagcatccctgtgaggagatcattccgtttctgcttgtgtactccagcaatggggaactcctgattattcttttttttttaaaaaaaatagcttcattgaggtataacttacattgcataaacttcacctgtgatattgtgaaatat

SEQ ID NO: 93887 - DNA, 505 bp, Homo sapiens
tcagcatcacactgtggggttggtttaggaaatcagtcttaatcatgcaactaattgacaggacattcagggtcataaagacacatttttaaaagatggggtctatatctagttgatgttaaccaagtgaactcatgttttcttacagaatgagccagctattatcattcatctagaaggaatgtgaaggctgtgatattttttagaaggtaagaggataggaatttttaaaatgtaattcagaaaaactgccctctcaaagaggcctgtcttaacctgacttaacctcatcagcaaaagctccatcaatatgctttaatatgaatcaggtaactagatggagctctagtctaggcttgtctttgagactccagaacaggagttctcaacctagactgcaccccagaccaattaaaacagaatccctagaggtagaagcagacatggctgttattttttaacttccccaggtaacttcaacatgtagtcacatttgataactatt

SEQ ID NO: 93888 - DNA, 929 bp, Homo sapiens
  misc_feature (688)..(688): n is a, c, g, or t
  misc_feature (753)..(753): n is a, c, g, or t
  misc_feature (837)..(837): n is a, c, g, or t
  misc_feature (851)..(851): n is a, c, g, or t
  misc_feature (878)..(878): n is a, c, g, or t
  misc_feature (883)..(883): n is a, c, g, or t
  misc_feature (908)..(908): n is a, c, g, or t
  misc_feature (923)..(923): n is a, c, g, or t
ctattggccagaaactccctccattttcttatgcttatacggaactggaagctattatgtatgcccttggagtgggagcgtcaatcaaggatccaaaagatttgaaatttatttatgaaggaagttctgatttctcctgttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggtttgacaagcccatattacatggattatgtacatttggattttctgccaggcgtgtgttacagcagtttgcagataatgatgtgtcagattcanggcagttaaggctcgtttgcaaaaccagtatatccaggacaaactctacaaactggatgtggagnaggaaaggaaacagaatttcatttttccaaaccaaggtcccaagaaactgggagacattgtccttttcaatggcatatgtgggntcttgcaccaaccntctgggtacttcaggttaggacacccnctgangggccggggaggtttcagggtaccnttgtatttgagggantagggc

SEQ ID NO: 93889 - DNA, 667 bp, Homo sapiens
tgtatttttagtagagatgaggtttcaccatgttgaccaggctggtctcgaactcctgacctcaggtgatccacccacctcagcctcccaaaatgctgggattacagcgtgagccaccaggcccggccaatttttgtaacttttacaaagatatttaatttaaaattgattttaataaaaggtagacatccaagaacacaggatgattaatgcacttcaatgttaggtgaatatctttaaaactgattattgtcaaacattaaatccatataaccgaagcaaactgcacacacctgtacaaaataaaggaagtaacttaagaaaataaagtgacttatccactgacatttcacaattagtatttgaacaatcaactcaaaagacacccatgtgttagtaaagtaaataaatgcatgttacttcttgcaatcttctgggaaggagtttaatgccaagccgtttcatggaaaagacaggagttaagaaatatggaggaaagaataattattcctcatcaggcgagtctggcgatacctaaatgtgtgtatgtaagggagtggctttaattaaggtatagaatccacatgtgccaattgaaaagcagtatcttcctgcccctcctcaaaagttcttctgctaccaagccatgacccacacctagccagac

SEQ ID NO: 93890 - DNA, 396 bp, Homo sapiens
ccgcctcagcctcccaaagtgctgggattacaggcatgagccaccgcgccaggccatagggggcttctataagctctgacatcctcctggtgtgcagatggccatgtgcgtgtgttggctgcgtgtgtgcccaggaaggacttcagaaggcaataataaccccccttggactgaccttgaggctctgtgcgagcagaacgtgaaagctgaggcagagttagaaactgcctggctgggtgttgaaagtttgcatggatccagagcctctcagcaaagagtagatgtgttggttccaggaggttaaggaaatctgtctaatcattagctaaccactaagttaactgcgcaaagaatccagtggccacacatgatgtagaatacagacttggcataatt

SEQ ID NO: 93891 - DNA, 618 bp, Homo sapiens
aggtgatctgcccgcctcggcctcccaaagtgctgggattgcaggcctgagcaaccacgcccggccaagtttgttctctttttaacatatagagcattttagatgtaccatgagtccctttttcttcccagtatcactcccagtttcctctcactttcccaagaagtagtattgccttaagtcatgatgagttcttagagaccatttaaaaaaacactcattagatgcacatgaaaagaggttcaacaccatgagccattatggaaatgcaaattaaaaccacaatgaggccgggcatggtggctcacacctttaatcccggcacttcaggaggccaaggcagaaaaatcatttgcgcccaggagttggagaccagcccagacaacgtagtgaggaccccatctctacaaaaaataaaaaattagccgggaatggtggctcacacctgtgatcccagctacttggggggctgaggtgggaggatcatttgagcccaggagtttgaaaccaacatgggcaacatagtgagacctcatctctacaaaaaaattaaatattagttggacgtggtggtatgcacctgtagtcccagcttctcgggaggctgaggtgggagga

SEQ ID NO: 93892 - DNA, 210 bp, Homo sapiens
gtgtttcacaggtattttaatgaatagaaatatcagacactaaaaagaatacccactataagatgctaatcacaaaataaatcttaacagttgtagggatgtgaattgattgaagtaagtttcagagattatgttgttgtaatttttaaagtaatgcaaattacataaatgcaaacttgttttaatcccatggaactgtaaattaagatc

SEQ ID NO: 93893 - DNA, 284 bp, Homo sapiens
ctttaaattgtcattgtgtggtttgctatgagatgctgagctgcaagtctattaaactgggctgtggtccttcgaaaagtggagaggtaagcccaggtaaaaattctggcaaatttgttgcaactaatagtctccatttagaagaatgctatttaatacaaaaattagctgggcttggtggcgggtgcctgtaatcccagctactcgggaggcgagacaggataatcgcttgaacccgagaggtggaggttgcaggttgcagtgagctgagatggtgccactgc

SEQ ID NO: 93894 - DNA, 323 bp, Homo sapiens
cggacctatccccggttctgggtaggcttgtatatgctgtgattggttagaaattgacccccaaatacagtggtataggaaaacacatgtttatttcatgctaattatcaccacataataagactgtactccatagagtgactcagcagtccaggctgacagaggttcttcatcctgtacctgccacctggaacacacagccttcctggtctatatggaagtgggagagacagtggacagtccccagcaggcttggcgtttactcaaagaccctggccagaactatccaaacagccccacctcattgcaaaggggctgaggag

SEQ ID NO: 93895 - DNA, 230 bp, Homo sapiens
ctatatatcctgcctccttcctgtgtacacaataggaaactgaggctcaaaggcactgactcccatgcagtaatcctctcactagcacggccagggcgtctcaaagagcaggtctgcgggaggatctgagggatgattttttaagagtgtcttcctgaagaggaacatcagcccccaacccctgagaagcttactccccagacaccatctgtcagggcactcaaagttta

SEQ ID NO: 93896 - DNA, 425 bp, Homo sapiens
tagatttttaaactgagctaactagaccacactacaacatacctggcttatgaaatgggagggctgaagtctgtagggctgcccggaaactcaggtaagagttgaaattgtaatcttgagtctgaaattcatagggaaggcctccatgcaggaaacttgggcaggatttctatattacaatattgaggcagaattccttcttcttcaaaaacatgtttttgcttttaaggccttcagctgatgggatgagagccagccatgttatccagggtactttccctttacttaaagtcagctgattgtaaattgttaatcatctctacaaaaccttcacagtgccacctcgattagtatttgaccaactaactaagcaccatcatgtagccaagctgacacataaaaattaagcacccctaggtgaaaag

SEQ ID NO: 93897 - DNA, 479 bp, Homo sapiens
gtcagaaaatgtctgttaaaactaaagggagaacattgaggaaacttgggaaaatgtgctggaataaggagaacatccctcaaaatgcttattcctcacttaggacaaactgggcacatgctgttttggactaactttcaagataaaattattaacgttgccactgaggaaattcagatgggaggaaactaaagggaactgcaaaggtggtctggtacagtagcacgtgcaaggtccaatccagagtcagcttgtaccacattctggcagccagaggtgctgtaggatcagggctctgctgccttagactggacacatcctgcctctttcttattctgttgttctctctggacttaaggctgattctctttcctgtttgtagattatgtttcccaaagttttgatgaccagttatacatgatgttttatatcatgcttgccagaccacgcttcccactgaaaaggtgtaacaaaaaaag

SEQ ID NO: 93898 - DNA, 1304 bp, Homo sapiens
cagaaatgtgaagaggcttttttagacaagttcaaaacatttgcctcagttgaaagagtcagtgtcatgaaacctcagcagtggtcctgggaggtgccacgttatggtttggaacttaatgaaggcagcagcattgatagaaatttctgtcaaatatcaccaaagtcataaatgccgtcactctaagaagaggggtttatttaactttagcatggatgtatccagcctctgaaatgggacaaataagccccgccccttctaggtactttgacaaaaacaggaacacaataaaagagcagacctctggaggctgaggcaggagaatcacttgaacccggcatgaggaggttgcagtgagccaagatcatgccaccctactccagcctgggtgacaaaagcaagactctgtctcaaaaaaaaaaaaaaaaaaaacagatctcacaatgatacagtcagttctcaagtggcatctgttgaagcagtggatgtcgtcacccaatattagaatatgtcttaaaccaaattaaaactttactttacacagagttttatggacacatgaagggtttcctcctgtgcccagggagcccaagaactatagaaaggccttcattgtccatcatttctgttcctgtttgggtcacttggtggctttgtctttgacttgttagttgtttctctatcttctgtgtctttgtagagaattttcttgacccacactcactgcctcaaagactagacatttgagagagtattaagtacttgaagaagacttagatctagaagcagctatgttagatgatcagacctcatacactgccacttggaagatgaggtgtggtcatggggttcagtttcagaaatgtgttctctctgttgatcgtttctggaggaagaaacatggggatgtgtttagagggaggatatgccagctacttatcataggaagtctagaaaaggcagccatagtgaggtcactatttgaaaaggagtaagaaggaatgtattgggcaggaaagagtgtgcatagactcttctaggtgaatcaggtgagctgtgttctatctgcggagaactagtgatggtggggcagaccaggcatcttcccctccacttgtcataggggtctgagaagggaaacatggggcagaattgggaatcaatctgtaacactgcttttaaactaagtgctgtatttcacattagacttgcagaactggaagatttaatgtcaattagagttaatgttgttttaccagtagaaaaaaaacgatattagaacaataacaacaaaatagtttgtg

SEQ ID NO: 93899 - DNA, 213 bp, Homo sapiens
cagaaatgtgaagaggcttttttagacaagttcaaaacatttgcctcagttgaaagagtcagtgtcatgaaacctcagcagtggtcctgggaggtgccacgttatggtttggaacttaatgaaggcagcagcattgatagaaatttctgtcaaatatcaccaaagtcataaatgccgtcactcctcacccagctatgaagatcctgctagagt

SEQ ID NO: 93900 - DNA, 528 bp, Homo sapiens
acgctttatggtttttatttttaatgaaactattatgttaggtaattgatcataatttggtcatttactgaaagaaacagcaacagataacctttgaaaactactggaaggtgaatcatctctcccattcaacatttgaatgacttcaattcacagtgacttagactaaagcaagagaacatcaaatgtactgttataagctgaactactaactcagaggaggaaccactggcaagcccataaaactgaaactcacaaaaccatgatttattgggagatgtttatgtcacttttgagaaaatattaaacaggtgcttttttatttgtagtaaggtcatggagtatattttgagtttcattgtattctaaattgaaattttgtacttttagggtattctgaaattcttaagtgattcagattagactttggatgctataggtaatgcaaaggcagaaaccatttcttctcttattcatcaccagatctctggtgtttcgtataggtcctcacatggctggtgaatgaat

SEQ ID NO: 93901 - DNA, 215 bp, Homo sapiens
atatgcattgtttcatttaatcgtgaggagtttatgaagagaatcctattattttgatgcgtatcaaaatgtaagggaactgaggctcaatcagagtaaaagaataagtgacttttttttgtgtatgttacacagctagaaagtcataaggcttgggtacaagtctctgccagccttattttaggctgtagacatttgctactacattatggtga

SEQ ID NO: 93902 - DNA, 280 bp, Homo sapiens
gaatctaagcaattctcctgtctcagcctcctgagtagctgggactacaggctcacaccaccatgcccggctaatttttgtatttttagtagggacgaggttttgccatattggtcaggctggtcttgaagtcctggcctcaggtgatccaccagcctcagcctcccaaaatgctgggattacaggcatgagtcaccatgcccagcctaaacctggcaagataataaataacctttttaagtgttgttgggcacttgtctggttgtttttctttaggtta

SEQ ID NO: 93903 - DNA, 120 bp, Homo sapiens
atcttatctgctgggagcagtcaatgaaagaattggcatcagtggcaaaggtgcttgtgatagaagccttatatggttagaggttctttgataggaaataaagtttgacttttttttttt

SEQ ID NO: 93904 - DNA, 475 bp, Homo sapiens
gacgggggtgtgttaattggggaaaggttataatggggagagataattaccggggaagtatatttaattgggttatgtattatagatctggggttcctctgtgttgattggaaccttggcagatacaccttcactgattttactgaaatttactgttccactaaagtaagggtaaaaagagaaggaacagaatagaaaactttcagtcttcagatttaatgctaccaactcattagcagacccagttttcagagttactagaggagtagagatgtctacagatttctgactaatgtcatcattagttttctttttaaattatgctgtggaggaaagttagttattttacataagagagaaagggtttgctctgagagaagcagcatataactttccacctctatattttaatgtaccttttgagtagggttaggagcagtgttggtgatatgggtgggaagcagggaaatactgg

SEQ ID NO: 93905 - DNA, 588 bp, Homo sapiens
aagcacaccttctagagaaccaactaaaagataaaatagatattgggaatttgaggcaaagcatctatctcacattttttctgaatcaatcaaaatacccagaagctatttgaatcagttacccctcccttatgtatcacatacatttttttcttaagctatctctaaattatgttctttcttctatgttgctaattgctgaaactcaaagtaccatatatataaatgatataatagttacacttttatccttccagcatcagttggatatttcttccttcctttctttttctttcctcctatcttgtcctatcctcacctttaaactctatttctatatttccaactgtctattggacattttccagtagatgggtatcatgcaacttcacattaaaatggaattaacttcattatctccacaattaacttcattatctattctttcctatccattcatcttctacaggtggccttacctctccttcatgcctcatgtgaagttaatcacaaaatcctgtcctgtccaccttctgtgtgtctctgcgtctgcctttcctttttagttctacaaccactgtgaaggca

SEQ ID NO: 93906 - DNA, 288 bp, Homo sapiens
gtggggaatgggatggggggttgagatgcaggcaccacccacgaggcccctcctttcctgtctctccttgcagccaaagcaaagggcgtccgccacccccagcttccctagggcagggtcactgcacccatttacagataagcaaagcaaggcccagaaagggccttcagtgagaggggtaggccaagatgtagaggcctccaggcccatctggcaaaggagttcagcagccaatggtgctgatgtgagagtttcccttcgagggttccagtcctggttccatcgctg

SEQ ID NO: 93907 - DNA, 195 bp, Homo sapiens
gatttgtggggcttgaagtttatataatttggggaactctgttatgatattatggtataataaataatacatatttggtctctgctgctggttcctgacacctggctcctaaaacctttggaatctctaaagggataagtgtctttttgtaagcagatgagatgactggtggctgggagctcctagatagctttg

SEQ ID NO: 93908 - DNA, 448 bp, Homo sapiens
atgctatcccttccctagccccccactccccgacaggccccagtgtgtgatgttcccctccctgtgtccatgtgttctcattgttcaactcccacttatgagtgagaacatgcagtgtttagtttgctgttcctgcattagtttgctgagaatgatggtttctagcttcatccatgtccctgcaaaggacatgaactcatccttttttatggttgcatagtattccattgtgtatatatcccacattttctttattcagtctaccattgatgagcatttgggttggttccaagtctttgctactgtgaacagtgctgcaataaacatacgtgtgcatgtgtcttaattctttctagaaagtacattttattttttattttttgagatgaagtctgactgtcacccaggctggagagcagtggcgtgatctcagctcacttcaaattct

SEQ ID NO: 93909 - DNA, 369 bp, Homo sapiens
aaaaaaaaaaaaaaaaattctacttgtaccttattccctatgagaatacttatcaaacttatctaaaaaagaaaaataggaacagccatatgcaaagtcagcccaacaggaaaggacatattagattaaaatacattgcggcctgggcttagtggctcacacctgtaatcccagcactttgggaggctgaggcaggcagatcgcttgagtccaggagtcgaaaccctgtctctacaaaaaaaaaaatacaaaaatctgcctgttgtcccagccactggggaggctgaggtaggaggtcaaggctgcagtgaaccttgatcattgctactgccactccagcctaggtgacagagtgagaccctgtctcca

SEQ ID NO: 93910 - DNA, 144 bp, Homo sapiens
gagatttatttttataaagagcccaggccagttgtcttatgtagtggatttgtcagatttatctatgattagattcaggctggacattgttttatttttgagacagagtcttgctctggctggagtgcagtggtgcaatctcaa

SEQ ID NO: 93911 - DNA, 647 bp, Homo sapiens
agttagaattctcagagactatgagggttcactatctgtttgctggaagatatacaagacttttgaggataatacttaaatgaagatagaccggatgtataatatgctttttcttagctttcctatgactctacttagcaacttttgctaaaagaaacacaatatatgactgactactttgaagacacatatattggacacttaaaatcaacaaaagcagagaggtcccaaacgtggtatcttttcacaatgatgtattttatccgaattcttggaattactcatggtgtctttcaaaattaaagatctgtgaaacctgaagcagatatgaatattagccagattatttcctactggggctaccctgatgaagaatatgatattgtaaccgaagatggttatatccttggcctttatagaattccttattggaggacagacaataataaaaatctagctcagagggttgttgtatacttgcaacatggtttgcttacatctgccagcagctggatttccaatcttcccaacaatagtctgggcttcattctggcagatgctggttatgatgtgtggatgggaaatagcagaggaaatacctggtccaggaaacacttgtacctagaaacgagttccaaagaattctg

SEQ ID NO: 93912 - DNA, 1067 bp, Homo sapiens
agttagaattctcagagactatgagggttcactatctgtttgctggaagatatacaagacttttgaggataatacttaaatgaagatagaccggatggtaattcagttggataatgatcagtgacgttgaacttcttttcatgtgttcattggccgtgtaaatgtcttcttttgagacctaacaatacttttaagactgttgcttctatatttgaactcctttaagtcattatagactgcatagtcactacttgttgctgttattacaataactgccagacagaaaaataaatctacttcagacttttaaggaagtttcatatcttaatacttttaattgctttttaatggacactagcgggaaactatcactaacaacctctgtagtggttttctcattttcgtcaagatgtgaatgtatttggattaacgtatgggaaaggggcttgaaaaaaataggaagctgaatttaatattgccttgagctaaatgttctctttttattttttctttttagtataatatgctttttcttagctttcctatgactctacttagcaacttttgctaaaagaaacacaatatatgactgactactttgaagacacatatattggacacttaaaatcaacaaaagcagagaggtcccaaacgtggtatcttttcacaatgatgtattttatccgaattcttggaattactcatggtgtctttcaaaattaaagatctgtgaaacctgaagcagatatgaatattagccagattatttcctactggggctaccctgatgaagaatatgatattgtaaccgaagatggttatatccttggcctttatagaattccttattggaggacagacaataataaaaatctagctcagagggttgttgtatacttgcaacatggtttgcttacatctgccagcagctggatttccaatcttcccaacaatagtctgggcttcattctggcagatgctggttatgatgtgtggatgggaaatagcagaggaaatacctggtccaggaaacacttgtacctagaaacgagttccaaagaattctg

SEQ ID NO: 93913 - DNA, 261 bp, Homo sapiens
gttggcctagtcatcctagtcgggttcctcatgcttaccatggtctttggccaagagtagttactgagcaaatgattgttaactgactagtagtaactcaggttactgtggaacttgatttctacttctatcctgtatcttgagcatataggaggtgtctagtcaacacttgatggattcagatttttctcgtgaattaaccatcttttgcagccaggaaggtgccctttgattctctctcctgagaagtgacctagtcgg

SEQ ID NO: 93914 - DNA, 250 bp, Homo sapiens
gcaattctcctacctcagcctcctgagtagctgggattacaggcacccgccaccacgttcagctaatttttgtatttttagtagagacagggtttcaccaggttggtcaggctggtctcaaacccctggcctcgtgatccaccggcctcggcctcccaaagtgctgggattacaggcatgagccaccgcacccggcctaaacttctttatttatttttatattttgtagagacagaatctcactatgttg

SEQ ID NO: 93915 - DNA, 219 bp, Homo sapiens
gaatttcgatctactaattttcaggtggaacagtatggttgcagagagtccatttggacatatatacactttcatgcattcatgtctttaacaataatttgtggccctgctgtgtttgttcactaactccttcgaacctaccatataagctatatctttattttccttgtaatttgggaggtccaatgcttcattaagctcacatgcctgaaactaatg

SEQ ID NO: 93916 - DNA, 448 bp, Homo sapiens
gaattacaactctgctgactaaatgatgaagtgaatagaaatgaaaaacgtggcataatttgttaaggaaatgctagctgctgcaggcaaaggcaacaatgagggaggctggatattgtcgaaggttatagaatgaaccagcagtcataacctgaggccttgctgtgacacaatggagggaaattttactcccagtgttttctttatattttaagggtttctatattttcaaagaggtcttcaattccctagttatctagctctgcccactgaataaatataggaaatgactttagattaacataaaaatacaagtttatgcctgtaatcagagtaactgaactgaatataagccatttagattctagatggtgtatttcaaataacaattcagagagccaaccccagaatgtttttctaatcacccatgtagaatggcattctcgag

SEQ ID NO: 93917 - DNA, 324 bp, Homo sapiens
cacctcccgggttcaagcaattctcctgcctcagtctcctgagtagctgggattataggtgcatgccaccacgcctggctaatttttgtattttttagtagagacagggtttcaccatgttggtcaggcttgtcttgaactcctgacctcatgatccgcccacctcgtcctcccaaaatgctgggattacagctatgagccaccacacctggccctgtgaattttttaatactgcatttcccaaaaagaatttgtctttctctactttttaaaaaaagttttccctgagtctattataaagtcattcttgaccagaaaactcaa

SEQ ID NO: 93918 - DNA, 2490 bp, Homo sapiens
cgtgtgggggtgtcttgcgcgtggtgtgtcgggggggtgagtgggtgtgttctggtgtccggtggtaagcggtgtcgcgtgtgggaggtgccggtagccgtggtgtgggcggcccgttgcttgttgcctcggctgttgtacgctgtgcccttcggctcgatgcgggcacgtactgcggcagtcgacgcgtcctcccccgcgctgggcggggaggaggcggctctgcgcaggcaccgaccgcccccctccccgaggagctgcggcgggaggacgcgggttcagcgatgagggacgaacctcagagcgcgctcggccgcccggccgcccgcagccgcggggctgacaaaccagcggcgggaggctgcgaagcggctgtgcctgtggcggctgctccttaccgcagcgccctccgttttccgcggacacggctgggcgtgcgcgcgcgcgtgcgtgcgatccttccgcggcgtccgggcacggagggtcccgggaagggcggggggagactgaggcgggggcgcggagggataccgccccgggacaatcacggccgccacgtgcgggaggcgccggccgggagcggtggcgggccgagcttcggacctcgggccggcggagagggtggaccccgcgtcgctctcggcaccccaggaacagcggcggcacggacgccttggagccccgcggccgggccgcgatgtgcttttctcctgtgttcgctgcccgggatgcggaatcttgagcctcggtgtcgggttacagagttgtcctggtgacgggatgcggagcgtttcctcctttttgttgtgggggcggctggtggcaggggcagctggtggcagggttgcccacgctaatctccgagtctctaagggcaccgtctttcctggatccctcttgcgcctcgtccataaaggcagacccgcgggcgcgcgccggcaacctgaaatcagagcaggcgtccgtggcgctcaggaaccttgctgagcttcgccgatctttcattgttgcttcatttgggtaccaagggcctctcattctgtggattctttgcctggaggagcccccttaatgttgctaatcacgtgtggttaaattgctcgtaaattccgaacaaaacaaatagcgacctgtgttacactgtttcttggtaactgggaaagttactggtggcttgaagtatacgcagaaaatacaaagattaaaaactagggaagagttcactgaatgaacaccgtaacatttctgctctgcagggtaaaataatttcgggacccaggtctgggaaagatttgtattaacaaggtaaacggtgggtagagtgcctgagaagctattcgtatcgtctttggtagcctctgggcactaggactagacatggaattaggggtcccccaacaatgacttcaattttaggttaatagaaaccatctgccacttaagggaaagaaagcaccaaaatgtagataagttgatgttcacccttaaagttatcgtgtgaggtcatgatttgtaggaggattaaggaatgtatctctggaaagggcaagaacgttgcttttaaaagtctaattggttctgaagttttatattttttctgctgattgctttaaaatgttcagctactagagagaaaaaaagtacagtaaaagaaacccccaagtcagagacctatcagactgagaatatgtattttctcatgttctaaagatacagaatacctgtgtggtgtaaaatgtgaaccaaaaattgtttcatttttgtaagtgtgcctcccacctgatttaattacacttaattgttcttgtttatgactctgccttttatggtgatgttgatcattttagtccttcgatcatagcactgtatcatcttaaaagttaataatagattacttgtaacacaggctcactatgtgagaattcatcaagctgtatgtacatttattattgtgctcttcattgtatgtataattcaataaattgaaacagtaaacgaaaaggtaattatagaaaaaatacagtgataacttgaagtatgttgaatttttattaatttactctgaaggttttaagatataatttctagacgttactatcttattgttatagcacagagttggaaataactacattcttttcctattcttttattgttggctttaaacagtgaaagaatttgaccaacaatattttctaattcaaatctcaaaagattctaaaacacatttcttgggtaaaatattcacaaaaatttagaattcttgtcattcttctatatttttcaaaatataattcattttaaattactgcttacttttccaacatgatgttatttttctagaattgcaaacagtaaaatttaaacaactatgaaaaaaattctgtataatagattaaattttacagtttcaatttttaggttatatattcaaagagagtccatgtgctgtcttggttttcagtactgtaataaagtaacctgtgctta

SEQ ID NO: 93919 - DNA, 1997 bp, Homo sapiens
cgtgtgggggtgtcttgcgcgtggtgtgtcgggggggtgagtgggtgtgttctggtgtccggtggtaagcggtgtcgcgtgtgggaggtgccggtagccgtggtgtgggcggcccgttgcttgttgcctcggctgttgtacgctgtgcccttcggctcgatgcgggcacgtactgcggcagtcgacgcgtcctcccccgcgctgggcggggaggaggcggctctgcgcaggcaccgaccgcccccctccccgaggagctgcggcgggaggacgcgggttcagcgatgagggacgaacctcagagcgcgctcggccgcccggccgcccgcagccgcggggctgacaaaccagcggcgggaggctgcgaagcggctgtgcctgtggcggctgctccttaccgcagcgccctccgttttccgcggacacggctgggcgtgcgcgcgcgcgtgcgtgcgatccttccgcggcgtccgggcacggagggtcccgggaagggcggggggagactgaggcgggggcgcggagggataccgccccgggacaatcacggccgccacgtgcgggaggcgccggccgggagcggtggcgggccgagcttcggacctcgggccggcggagagggtggaccccgcgtcgctctcggcaccccaggaacagcggcggcacggacgccttggagccccgcggccgggccgcgatgtgcttttctcctgtgttcgctgcccgggatgcggaatcttgagcctcggtgtcgggttacagagttgtcctggtgacgggatgcggagcgtttcctcctttttgttgtgggggcggctggtggcaggggcagctggtggcagggttgcccacgctaatctccgagtctctaagggcaccgtctttcctggatccctcttgcgcctcgtccataaaggcagacccgcgggcgcgcgccggcaacctgaaatcagagcaggcgtccgtggcgctcaggaaccttgctgagcttcgccgatctttcattgttgcttcatttgggtaccaagggcctctcattctgtggattctttgcctggaggagcccccttaatgttgctaatcacgtgtggttaaattgctcgtaaattccgaacaaaacaaatagcgacctgtgttacactgtttcttggtaactgggaaagttactggtggcttgaagtatacgcagaaaatacaaagattaaaaactagggaagagttcactgaatgaacaccgtaacatttctgctctgcagggtaaaataatttcgggacccaggtctgggaaagatttgtattaacaaggtaaacggtgggtagagtgcctgagaagctattcgtatcgtctttggtagcctctgggcactaggactagacatggaattaggggtcccccaacaatgacttcaattttaggttaatagaaaccatctgccacttaagggaaagaaagcaccaaaatgtagataagttgatgttcacccttaaagttatcgtgtgaggtcatgatttgtaggaggattaaggaatgtatctctggaaagggcaagaacgttgcttttaaaagtctaattggttctgaagttttatattttttctgctgattgctttaaaatgttcagctactagagagaaaaaaagtacagtaaaagaaacccccaagtcagagacctatcagactgagaatatgtattttctcatgttctaaagatacagaatacctgtgtggtgtaaaatgtgaaccaaaaattgtttcatttttgtaagtgtgcctcccacctgatttaattacacttaattgttcttgtttatgactctgccttttatggtgatgttgatcattttagtccttcgatcatagcactgtatcatcttaaaagttaataatagattacttgtaacacaggctcactatgtgagaattcatcaagctgtatgtacatttattattgtgctcttcattgtatgtataattcaataaattgaaacagtaaacg

SEQ ID NO: 93920 - DNA, 487 bp, Homo sapiens
ctgtagtccgtttgctttattaatatttatttatttatttttgagacagagtctcactttttcacccgctgcactctgacctgggtgacagagtgaaaccctgtcttaaaaaacaaaacaaaatccaaatatttacacctgtgtcatcaccacccagatcattgtttagaatatttccgccaccttagaaagttttgtcatgccttttttttcagtcagtccctccccttcactcactgcaagaccaccactgttgtgacttttagcatctaaatgtagctttggaatcatgtagtatgtactctcatgtctctgaaattcatccatgttgttgcataattcagtagttcactactttttaatttctgattagtatttcattgtatgggtgtactgtaatttgtttaaccattcacctgctgtttaatcttttgagctgtatgcatttggctattatgaataaagctgctttgaacattcctataaa

SEQ ID NO: 93921 - DNA, 411 bp, Homo sapiens
ggttatttatttatcatcagttgtagcagttctttatgtattctggaaccaagtctattggattccaaatacggtattttctttgtatatatggtaaatagaatactttctcttttaagtcataagatatattttaagatattaaatgactaaaattatttaggtcataagttaaatatttttttcctgtggtggtattttttaatcccttctttccacctagtcactttttggaatatctgtagcaataatagtaggaacagtagatgtgcctttggagtgaaaataaatagccatttaaaacataggcctttatcaacatttagttctttcaattaggaaatggagaatgaatgtttgagtttttaaggggaattaattgaatgatattttatcatttaagatgaaatc

SEQ ID NO: 93922 - DNA, 494 bp, Homo sapiens
ctgtagtccgtttgctttattaatatttatttatttatttttgagacagagtctcactttttcacccgctgcactctgacctgggtgacagagtgaaaccctgtcttaaaaaacaaaacaaaatccaaatatttacacctgtgtcatcaccacccagatcattgtttagaatatttccgccaccttagaaagttttgtcatgccttttttttcagtcagtccctccccttcactcactgcaagaccaccactgttgtgacttttagcatctaaatgtagctttggaatcatgtagtatgtactctcatgtctctgaaattcatccatgttgttgcataattcagtagttcactactttttaatttctgattagtatttcattgtatgggtgtactgtaatttgtttaaccattcacctgctgttcaaagcagctttattcataatagccaaatgcatacagctcaaaagattaaacagcaggtgaatggttaaa

SEQ ID NO: 93923 - DNA, 746 bp, Homo sapiens
gtcataagttaaatatttttttcctgtggtggtattttttaatcccttctttccacctagtcactttttggaatatctgtagcaataatagtaggaacagtagatgtgcctttggagtgaaaataaatagccatttaaaacataggcctttatcaacatttagttctttcaattaggaaatggagaatgaatgtttgagtttttaaggggaattaattgaatgatattttatcatttaagatgaaatcataacactagacacatagttgtatgttttaggaggaaatttagtttttctatctgtgcttctcatgaataggagcacttcttgagtactctggggtgatttaagccctttcccaccaactgtagtccgtttgctttattaatatttatttatttatttttgagacagagtctcactttttcacccgcctggactgcagcggcacaatcatggctcactgtaacctcagcctccagggttctagaggttgtcatgtctcagccacctgagtagctgggattacagacgtgcgccaccacgcccgggctaatttttaaaaatatttttagtagaaacagggttttgccatgttggccaggctggtctcaaacttctggccccaagtgatctgcccgccatggcctcccaaagtgctaggattacaggtgtgagccactgcgcccagcttattaatagacatttaatataaagaagtaaataaactttttattgaggtata

SEQ ID NO: 93924 - DNA, 601 bp, Homo sapiens
caaagacactttcatgatgaaatttgttataaaattagatggtgatgtgagggataaactttggcttcaaaccagctcaaatgtggtttattctacagtcttccccaattcttctctgtggaagagatgcgctttcaaattcttataagcttttctttctttttgacagggtcctgctctgttgcccaggctggagcatagcagcatgatcatagctcactgtagcctcaaattcctgggcttgaatgatccttctacctcagccttccacatatgtgcatgctaccatgcctggctcattttttaatttttatagagacagggtctcactatgttgcccaggctgatctcgaactcctggcatcaagtgatccttcctccttggcttcccaaaacgttgggattataggcatgagccactacgcccaggctggagtgcagtggtgtgatctcggctcactgcaacctctgcctcctgggttccagtgattctcctgtctcagcctccggagtagctgggactagaggtgtgcgccactatgcctggctaatttttttgtatttttagtagagacagggtttcaccatgttgggcaggctg

SEQ ID NO: 93925 - DNA, 2033 bp, Homo sapiens
ccctcgatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgaggtaggaaaaggaggctcctcaaccacaacttctgacctcccagggtgtctgaggcctctaaagagcttagtttgcccctctgggaagtgaatccttggcttatggtgccggggggaccctggaggccccctcacacgaaggctgcttcttgcagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93926 - DNA, 446 bp, Homo sapiens
  misc_feature (10)..(10): n is a, c, g, or t
aacccccccnccccccgagtagaggagttttttttccttccgaccccccccagtcttggaggtcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93927 - DNA, 665 bp, Homo sapiens
ccctcgatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93928 - DNA, 1917 bp, Homo sapiens
ccctcgatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93929 - DNA, 1739 bp, Homo sapiens
ccctcgatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93930 - DNA, 2184 bp, Homo sapiens
ccctcgatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggtgaggctgcggggactcgcatttggactcgcattcaggacgcctggggtctgactctgaagaaagaatggtcctgatcactgcagtttttgcagacaagcccctgcctgggctgtcctgggggttccctccgcttcctatcctagtccagatgccctgggtgggacccatccccacctctgccctttccaagcagggttctcccgcccctccgccccttggagctgggagtgatgctttgccctggcttcccaactctctgcccaggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93931 - DNA, 1988 bp, Homo sapiens
ccctcgatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtggtgagctccctgctggctgggcagacaagcctcagctgtcaagcagccctctcacagccctctgcccccagggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93932 - DNA, 1937 bp, Homo sapiens
ctcggatcggccaggcctggatatcagcgaacagatgcggatttccaccagggggcgctaggacgccacgacctttcactatgtgcaccagggggcgctgccgcccgccttggccatcccgggctgggaagtccgacccttcgattaagccccgcctgattgggaaaggctctgagaaactatttgcatgatcttgaaagagctgtgctgaatggttgagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93933 - DNA, 1203 bp, Homo sapiens
ctagcgtatccttgggcgcgaggcccagagacttcctgctaaggtacatggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93934 - DNA, 724 bp, Homo sapiens
tgctgcggtgacctagaggatccggcacacccgtacggcggcgttcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaaaaaaaaa

SEQ ID NO: 93935 - DNA, 1217 bp, Homo sapiens
ccctcgatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagctgcacagcctcaggaagtcatccatattctctggactcccccgtttggaaatctcagaagacaatgagttctgccctcttcccttctagaactcctgttgtgtgtcaggtcctgtatggacattttgaaaagtttctccttttttcctctgagcaagcagccctgtgagagaaatgacatcttctcctaatttttagatgacaaaatgatgcccagag

SEQ ID NO: 93936 - DNA, 1287 bp, Homo sapiens
ccctcgatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagtctcactctgtcggtcagactggagtgaagtggcgtgaactcggctcactgcaacctccgcctccccgggttcaagcaattctctgcctcagcctcccgagtagctgggattgcaggcgcccaccaccatgccccgctaatttttttta

SEQ ID NO: 93937 - DNA, 261 bp, Homo sapiens
gatttagtggtcctaggttcatgtgatttgggagccttaagttgttatttagattgattcagcctgattcaccatcttttttactacagttctacatgaatgtggtgaaacaggtagaagaaaattaagcatttctctgcttttggagtctaatgttcctgcctagtgactggtttgtaacacccccctcacccctactttgttaggaacctgcaattcctaaaagaaataaataaagctgtacccaatgtccattcttta

SEQ ID NO: 93938 - DNA, 565 bp, Homo sapiens
acctttgtcctgtgtctccctaactacactgtaatcttttgagtgcagagactctgccataacctggaaccctagcatgcagtatactttccagtacacaacaacttataattttacctttggtgactgaatactcttagctttttaaaagtcatcaagaaggagaaaatgcttaataaaatgaatgaaaaatcaaagtcatgattaaaattacttaaataggcacaggtagtatcacacactaaactgctaaatctatgatacttaccatgagccagttcatgtactcagttcatgaactcagtcacaactttgaggttatactattattacctacattttacagataagaaagctgaggggcagaacctccattaagaggttcagggaagccccaaaactctaagttttgtcttaaaacaaaaaaattaggtgaaagaagaggggggaagtatcccaagagactttgcttgtttaaaagtatctgaaaagaaagaaaagacaaagactagaagagaagtttcattttattcacggatgatataaatgtctatgacacaaggca

SEQ ID NO: 93939 - DNA, 163 bp, Homo sapiens
gttaccagttctgcttttcctggacctgttccaagctctcacgttccacatcacacatgggacatctagtgtcaggctcccagagagcaggaaccaggtgaaatacaagagcacagtcctcccagccggtggcatggggataatcggacaatacaactctcca

SEQ ID NO: 93940 - DNA, 175 bp, Homo sapiens
ttgtctcagcctcccaggtagttgagactatccataggcacgtgctgccatgcccagggtatcactttgttgcccaggctgcctacctcccttttagatttgaagtcctttcaggagagaaactgagtttccttcctgaacttgaatgttgggtcctcccgaggatggcccccta

SEQ ID NO: 93941 - DNA, 384 bp, Homo sapiens
acacatcacatacacacacacacacacacacacacacaggtgcatgtgcagccatgctgctttgggaagttgtttctcagctcactcattgattgcgttaacaaagagttacacaatgctttttctgtgagaggcactgtgctaagacaaagggtagatacaaagacaagtctgctaccatgcctggtttttgtaaaagagataaaacaagtagaaaactataatatataaggtcagaggatttaagggacagcaaggaaactacaaataaaagatcaagggagttgggtggggagaataggggcagatgaggaatggggctggcttcagggagaactctgcttctgttccacgcctggaagatgtgtgggtgtgaaaagaaag

SEQ ID NO: 93942 - DNA, 442 bp, Homo sapiens
gccacacatagatgcaaacactgggaagttggctaaggtgactcattaagtgagtccatcgtatctatcaatcttgagtaattcgggaattccaaaatgtgcagcagccaaataacaaatgaatgtcccgaacatttatttatttatttattttgagatagagtcttgctctggcacccaggctggagtgcagtggcgctgtctcggctcagtgcaagctccgcctcctgggttcacgccattctcctgcctcagcctcccaagtagctgggactacaggcgcccaccaccacacccggctaattttttgtatttttagtagagatggggtttcaccattgttagccaggttggtctcgatctcctgaccttgtgatccgcccgcctcggcctcccaaagtgctgggattacaggcgggagccaccgcacctggcctgtcct

SEQ ID NO: 93943 - DNA, 606 bp, Homo sapiens
aggctgcagtcttggctcactacagcctcaacctaccatgctcagtcaagcctcccacctcagccacctcagtagcttgggccacatgctcatgccaccactcctggctaatttttttattttttgtagagatatggggtcttgctgtgttgctcaggctggtcttgaattcctggactcaagcagttttcttgtctcagcctcccaaagtggtgggattacaggagtgagccaccgcaacctgacctgtaattttcttgtaatgcttttgtccccttttggtgttaggtttatactggcctcttaaattggaatgtgatactttcattgttttccgaaaaagtttgtgtaagattggaattatttcttcattgaatagaggcatacctcattttattgtgcttcactttcttgtgctttgcacgtatttcattttttacgaattgaagggcttgtggcagccctgcatcgaccaagtctgttggccagcagcatgtgctcactttgtctctgtgtcacacttcggtaattcttgcaatgtttcagattttttttactgttatatctgttacggtgatctgtaataagtgatttttgatgtcacta

SEQ ID NO: 93944 - DNA, 96 bp, Homo sapiens
gaaatatttaggtagccaatccccagcaaagtgatgtactattaataaagctgtgcccagcataaaacagagtaaaacgaggaaaaaagaagccaa

SEQ ID NO: 93945 - DNA, 475 bp, Homo sapiens
gagagggcctgtctctccagggtagggtagtagactcaggactcagggaatgcagtcagctgcgtgggcccctgtgctctctaggaagctgggagacaaatgttataaagaaactcttaccccataggatgcccttttctgatttttcaactataattacctggaaagtggtccatgtccacgggcctagtgggctctaattctgtgaggtgacctatcattgcccacctgccccagaggccacgtaaggttgggttgagtttttgcaggaagtatgggaaagcctcccttgaaggtagactttgcatctgaccccagagcttctagttaagtggctttaggcctttggtaagtccttaacaaatctgagtctcctctgatgaggactctagccttctacttacacctctgggaaactattctgtaatgaggcaacatatatcaaatgcgtgtctagtgctggggatgttgcagg

SEQ ID NO: 93946 - DNA, 486 bp, Homo sapiens
tatcaagacacctgccgagcgtctgcgggggccgcttccaccctcagccgatgataatctcaagacaccttccgagcgtcagctcactccccttccaccctcagctccaccctcagcagatgataatatcaagacacctgccgagcgtctgcgggggccgcttccaccctcagccgatgataatctcaagacaccttccgagcgtcagctcactccccttccaccctcagctccaccctcagcagatgataatatcaagacacctgccgagcgtctgcggggagcgtctgtgggttccgcttccacgcctcagcggatgataatctcaagacaccttcgcaagacgtcagctcactccccttcacacccatcagcatccacgccgtcagccagagtgataagtatcaagacacctgcacgagcgtctgcgggggccgcttccaccctcagccgatgataatctcaagacaccttccaaacgtcagc

SEQ ID NO: 93947 - DNA, 697 bp, Homo sapiens
ctacactgaagatgttttgggcatatgttaagtggtttttctcctttaatctatggatatatcatctcaaacagtgaattatatttgtttgagaaggagtctcactctatagttttttacagtgttgaactatcattctattttgagggtaaatggctacgtttgatttacggctacattttgaagtgatactgagcttttcgttttggtgctgccctagtccagtttgggatcggggctatgctggcttcatacagtagtaagaggaggcttgtcattactttctttgcgctggtacacttacagtaacataggtattatagttttggaagatttgataaaactctcccacgaaacatcctaggccctggtgtccattttggggacatcaaaatcttcgaataccatttctaccttttttttttttttttttttgagatggagtctcacttatcacccaggctggagtgcagtggcgcgatctcggctcacgtgtttcatagcctttcaggagttcagggctaacggtcaaccagccagcctctttggcagtcagcctgaagggggccaagggggcagatcgatgccaaggtgcacagcccctcaggagccctggaggagtgctatgtcacagaattggaccaagataagtatgctgtgcgctaatccctcgggaaaagggagtaacctgatggac

SEQ ID NO: 93948 - DNA, 534 bp, Homo sapiens
aggtgaagccatttaccccaagtgagcaggtgaggaggccgtgcagcctaggagctgtgccaaccctaagcccatacccctttctagaccatgctacacatgtcacaaccccagatttccctgctgttttccagagcctcttccctgggtccctcctccccagaacactggtgtgtgtacccctaggcccaaggggtggccaaggggcatctgtctgtgagtgtgactttgcacttaggagctggtgtgacccctgggctgaacgtgaggccctgtggtgcaggacagagactaaggcagtgtattcatttcctatttctgctgtaaaaaaattaccgcaaacttactatctgacatttatggaggccagaggtccaaaatgggtctcactgggctataatcaaggtatagccatggctgtgtccttcctgaggctccagggagaatctgtttgcttgccttttccagcttctagaggccacctgtgttccttggctggtggccaccttcaaagccagcaatcccatcactcca

SEQ ID NO: 93949 - DNA, 392 bp, Homo sapiens
agtttttaataatatttaaaggtaatctcactaaattacaaatagcactgcatttaacttgattgctgcagcaaacatgaaattaagattttcatactaaaatattatagacattttgtataggtccaatgttagctatatcatgtacattaatatttattaaagttgtgtgtacatacatcttgtactcattactattgcatacgtgtagtatatcaagcattataataaaaaaattatgatttttaaaaaaccattctttctcaggtgtatagtctactgtcaataaaaaagaatcctgtaaacgctgtaggaagagatgtgaagcagggagagtcgactactgtttactggagtctactttgtagctaaaatgaaacagcttaaaattt

SEQ ID NO: 93950 - DNA, 398 bp, Homo sapiens
agtgagcatgatctgcgtatagtgcttgtgaagagtagcgtgcagtgccaggatgcactggggctttatagatggctgtgttttccttgcacatcattagcctggagccacacgaaagaggaaaacagagaagtggagagtttatgctccctgctggtgtttaagaagccagggtcctggaaggacatctgggaattgcactgagatgggggtttttgtaatttaagaatagacattcattagcagtaaatgccataaatcccatgctaagtaaaaaccttgtccaagaaagcctaaaacaataaactctgtgctcaatgtagcctgagctggatgctctgtagctttctgaggaatactagagatccatcagctcattcccagacctgctccctcct

SEQ ID NO: 93951 - DNA, 367 bp, Homo sapiens
agttataagtaaattcaactacctaatcatagtattcagttatcatgaacctgatgatactgatgtgaaattgaactataatctcaaagtttagagctcattaaattaaactgaaataccatttaaaattgatcttcaatggcactagccacatatccagtgctcaatagccatatgtgtctagtgatttctatatgaaacagtaaaacaatagactatttcctttatcacagcaagttatattgggatagatagatgaatagttagatgatagatagataatatataagtagatagatgatagatggataaatgatagatgatagatggatagatgatagatagatagatgatagatagatagata

SEQ ID NO: 93952 - DNA, 421 bp, Homo sapiens
agttataagtaaattcaactacctaatcatagtattcagttatcatgaacctgatgatactgatgtgaaattgaactataatctcaaagtttagagctctgctgtccaatatggtagccactacccactagtggctatttaaaatcaaatttcattaaattaaactgaaataccatttaaaattgatcttcaatggcactagccacatatccagtgctcaatagccatatgtgtctagtgatttctatatgaaacagtaaaacaatagactatttcctttatcacagcaagttatattgggatagatagatgaatagttagatgatagatagataatatataagtagatagatgatagatggataaatgatagatgatagatggatagatgatagatagatagatgatagatagatagata

SEQ ID NO: 93953 - DNA, 401 bp, Homo sapiens
tttcttactcaaaatgtcagtaaccctgttggcaggcgtataagaacagttgtgctcttacactttgctattgaaagtataaattgatagactttctggaagacagcttggaaatacataaatatatactgaaactttaaaattatgcgtgtcctttgacccaacaattacacttcttggaacttttttatttttatctgttttagagataggatattgctctattgcccaagttggcttcaaactcctgggctcaagtgattctctcacctcagccttccgataactgggactacaggcacacgccactgcacccagccattggaatttatcctaaagaaagaatttaggatgtgaaaaaagatttagttataaaagttcattcatcacaatgctattta

SEQ ID NO: 93954 - DNA, 363 bp, Homo sapiens
tcctagatggatatcttgaaagaaatacttgaaggctattagtgattgtcatgattatttctagatagtgagattagagatgatttctggcttcttttccatcattttctaaattgtcaaatatgtgttaagaagattagatatgaagtagttttgaacaccaaaaagtcatattgaagtgtaggtaccttggcaaagtagctactactttttcttttttgctttttcagggagtcctctgaagttccttcttagatggggggactaaaatctgcttttgtgagattccacccgtaggtcctcctcctgccaactccccaccctgagcttccacagatgtttccttctgtctctctgcacctt

SEQ ID NO: 93955 - DNA, 385 bp, Homo sapiens
ctcattttgttgctattcagttgtttgagttccttatgtattttgaatattattttctttattaggcagaagctttgtagtttgatgtaatcccactttctatttttgcttttggtgcctgtgctttagggaccatattcaaaaagtcattgcccagacttttcttctagtagttttacggttttgagtcttacatttaagtctttaatccatttttgttgatttttgtatatggtaagagacaaagggtctaatttcatttttctgcatgtagataggcagttttcccaacactgcttattgaagagactgtcccttgcccattgtttgttctcggctcctttgtcaaaaatcaattggttgcaaacatgtggatttactcctg

SEQ ID NO: 93956 - DNA, 506 bp, Homo sapiens
tagtcatttacaactaaatgaatattgaatatttcctcgacctcaatttctgtccagtgacttcaacatcaatcaatacagtattgaaagggaatctagtcagagcacatgtcctgatgctattttcccaaaggcaaggactaggtcttttcatctcctaggacacagtggctcactaagtagagcatagggaattaggggatgggtgtggaatgtgatagctgcaagagatgtttccaagcactacacatatagggcagagttcttctaggccaagaagtcggaagctccttttgcagtgcagatccgacttacttgacgactgcctaacttctggctctcacagttttattggagaatatggaatgatttcctttcatggcctgacaccttcagaactcccgatggtaattacaggcaattagtgtggtggctgagagtggagtcttggtgtcttggtttctttatgtataaaatgccaccatccttcttcacttcgattgcta

SEQ ID NO: 93957 - DNA, 307 bp, Homo sapiens
tgacattttgcagcatattttgttatctcctacattcagctatatttaatagcctgttttacatgaaattgaacagaaaatgttaagcccagaaatttgttcaattagatatcatatattggggggaaactaattttcttccagtggtttagtagtttaagaatgagcatatagtctcttaggaataaattgaaaattctaaccattgagagtacagcagttttttttttccatttttttttttttttgacacaatggtaaatgcccaagattggaaactatttttaaatgaaaataacatatgttt

SEQ ID NO: 93958 - DNA, 228 bp, Homo sapiens
ggtgggtgaataatctttatttggtctgtactttctgcttccaatctgggaatttttccaagaaaacactgactgaaatacagtcagaatttatatatgcatttacattaggctccaacaataagattcagcctttttcaaaactgtcacttgcatagccaataaactagtgtctcaaaaatccatttaattttccatacttcccaaaaccatttcaatgcgatgatc

SEQ ID NO: 93959 - DNA, 276 bp, Homo sapiens
agatgaacagagcgtggaagacttccagggcagaaaaactctgcgtaatactataatggtggacacatgtcattatacatttgtctaaactcatagaatatacaagaccaagtaaactctagactttgggtgataatgatgtatcaacgtaggttcactgactataacaaatggaccactatgatgaaagatgttgatggtggaggaggctgtgcccgtgtgaaggcaggggttacgtgggaaatctctgtactttatgttcagtgttacgtgaag

SEQ ID NO: 93960 - DNA, 114 bp, Homo sapiens
gacagcacaagaatggagggtgaaaattcaggatttctagccagtctgtccaggttcagatcctgtttcttccagtaccaggcaacgtggggtgggcagtcccttctctgtgct

SEQ ID NO: 93961 - DNA, 289 bp, Homo sapiens
tgcttggtgtgcctgttggctcagactctggtgtgcctgaattctgagcttagtgctcctttcctgtggcttgggatggtggtaatttcatgcacagctaaactcagaatttctcagagccatctggtcaccggccaaggattttgtgcatttgggtggagaggccaaaatgtcagtcagggaaaacaaagcaaatatctcctttaataacctgtctctgggaatcagccaagtttaagcctatcagaggtccttcagcccaccccacatgcgaggctgggctgccctc

SEQ ID NO: 93962 - DNA, 164 bp, Homo sapiens
catcccttcatctggatccatcctgtcttccatttattcctcctttgagatctttctatatttctctatcatttgccaaaaaaatctaagccctctctcccttaggctacttctgtttattgttcttatttccacctttgcgttgtggtgtaatcgtccatctc

SEQ ID NO: 93963 - DNA, 569 bp, Homo sapiens
caaggaaccaagacccacagcctccattctcccaaggcctggcctctgcataccctctgtaaacattcatccatgaagctcagtccaaacacgcaagttccagaaccatgcagccaacacacacgtggctttgcagaaaacatatgttcccaaacacacggaaaagccatcagaacgggctacagttaagctaaaaggagttatctcggcagcagggcagaagagggtatttttactttcttctttttatttgcccgttattttttctgatcttctttcactgagagtcactctttgtgtaatacagctgtttttgaaaatgtgcttaacaacaaaggaagcctgcattcagttatccatggacgccttcatcccaccagctaaagtctggtgcacccaggctgtgctggaaacactctcaggataaggaggttagaaaaaacaacccaggcctcacctgtgcagccctgggttcaaatcccagccccctctgccactctccagttccgtgacctccagcaggtcattcaactgcttcctgcctcagttcctcatctgcccaatgggga

SEQ ID NO: 93964 - DNA, 602 bp, Homo sapiens
  misc_feature (34)..(34): n is a, c, g, or t
cgatgagtaaatcttggcgatgagtaaatcttgntcgatgagtaaatcttggcatctccaaaaaggcattttaaatctgtatttcctaattgttcgagaaacataaaagaaatttttggagatgccaagttcaaatatgacaagactctaaggagaaaaactggatattaaaggtttaaaaaaacaagttgacaaggagaacagagaaggcaggtcttgttatctagagctagacaccagctaatatcttggtagtcaactacttgatagagttgctttgtcatctatcagtggagaaagaaagttttctctctgtctgtgatctctctctctccagtggaaagaaggtgcaggcagagttgctggtgttatcaagggtgtgggagtggaggttactttcctttctgagttaacacttgatgttttggagcagtggcattgtaaagtgtcctaggaaaaagtccagtctagaaaggacagattaggggaatgaaaagcagcagttggttgaattttaaaagatgaggttcttagggggcttagggtaataaaactcagaatgcaataccaagattaccatcggtaccgagctcgatctatcc

SEQ ID NO: 93965 - DNA, 1281 bp, Homo sapiens
gcagagggaaaaggagaggagtatggatggatgtgttattgctcacattctagttcttgagtttacaggttcttattatgacattgaacttcataactatcaagctatacttattttgcagaaacaaatatgttaaagttgttctcattatcattaaagataatttgtcatctttatgggttaaataagaaaaaccagaacatgtttcaatagatgccaaaaaggcattttaaatctgtatttcctaattgttcgagaaacataaaagaaatttttggagatgccaagttcaaatatgacaagactctaaggagaaaaactggatattaaaggtttaaaaaaacaagttgacaaggagaacagagaaggcaggtcttgttatctagagctagacaccagctaatatcttggtagtcaactacttgatagagttgctttgtcatctatcagtggagaaagaaagttttctctctgtctgtgatctctctctctccagtggaaagaaggtgcaggcagagttgctggtgttatcaagggtgtgggagtggaggttactttcctttctgagttaacacttgatgttttggagcagtggcattgtaaagtgtcctaggaaaaagtccagtctagaaaggacagattaggggaatgaaaagcagcagttggttgaattttaaaagatgaggttcttagggggcttagggtaataaaactcagaatgcaataccaagtgattaaagaactaaattgggcccacatcagtagagggttggtacctaagcagccataggaaaagggcagttctttataatacatgaaaagcctagggtttaataaccacttagtaaggtatgttatggatatcttattttagagtaagaatataaggcatagccatatttatgaaggtagtaatactctactaatcaatacttagaagtttttgttatgactaatctgaatgctttttagtttttccttaatctagttatgttggtaatttataagtcagttttcagattaggaaagaaggtatttgagggtgttccatttccactgaatagtaagatgatgcttacttagatttccacagctgtttgaaagctctgtatttggctataacggaaaactttgttagggatgcttgatgttttgtgttttgtttctaaaggaagacagtgttttgttccttctttagaaaacttgaagaatagaataatgagtccaggattaatttgggataaagtcttttacttcataaattctgattctgtaaaaaaa

SEQ ID NO: 93966 - DNA, 1122 bp, Homo sapiens
  misc_feature (34)..(34): n is a, c, g, or t
cgatgagtaaatcttggcgatgagtaaatcttgntcgatgagtaaatcttggcatctccaaaaaggcattttaaatctgtatttcctaattgttcgagaaacataaaagaaatttttggagatgccaagttcaaatatgacaagactctaaggagaaaaactggatattaaaggtttaaaaaaacaagttgacaaggagaacagagaaggcaggtcttgttatctagagctagacaccagctaatatcttggtagtcaactacttgatagagttgctttgtcatctatcagtggagaaagaaagttttctctctgtctgtgatctctctctctccagtggaaagaaggtgcaggcagagttgctggtgttatcaagggtgtgggagtggaggttactttcctttctgagttaacacttgatgttttggagcagtggcattgtaaagtgtcctaggaaaaagtccagtctagaaaggacagattaggggaatgaaaagcagcagttggttgaattttaaaagatgaggttcttagggggcttagggtaataaaactcagaatgcaataccaagtgattaaagaactaaattgggcccacatcagtagagggttggtacctaagcagccataggaaaagggcagttctttataatacatgaaaagcctagggtttaataaccacttagtaaggtatgttatggatatcttattttagagtaagaatataaggcatagccatatttatgaaggtagtaatactctactaatcaatacttagaagtttttgttatgactaatctgaatgctttttagtttttccttaatctagttatgttggtaatttataagtcagttttcagattaggaaagaaggtatttgagggtgttccatttccactgaatagtaagatgatgcttacttagatttccacagctgtttgaaagctctgtatttggctataacggaaaactttgttagggatgcttgatgttttgtgttttgtttctaaaggaagacagtgttttgttccttctttagaaaacttgaagaatagaataatgagtccaggattaatttgggataaagtcttttacttcataaattctgattctgtaaaaaaa

SEQ ID NO: 93967 - DNA, 732 bp, Homo sapiens
ctctggagtcagaaatctgaaatggaggggctggcagggctgtccttcctcctcaggctgagcggagaatcctgcctggcctttcccagcttctggaggctccaggcgttcagggcctgtggctgcagaactccagtctctgcatgcgtcttctctgtgcctttcctctggatgtctttatgaggacacttgtcattggatttatggcctgcccagataacccaggatggtctcctcaaaatcttccacataattattttctcaaagtccccttttccaaataaggtcacatttgtgggtcccagaggttgggacatggatctatattttgggaggtcaccattcaacccattacacacccttgaaggtgtcttaagtagtgacagggacatgttgataaggacgtgaagggctagccatggggacctgacagctcttccaatgccggctttcgtattttctctccgtgccccgacccgtctctgaaccacccaccccagactgcagcctccttgggcttctccctcagttgcctgccgggaatgccgtctcccctgcatctcaaggccccacctcttcttccagctgtagctctgctctgcctcctccaggaagccctgactgactcatggtccctggactcctctcggcccttgcctcccttgccactccctgtctacaccatccttggacttttaacctctggccttgctgggtcttttttcttgcccc

SEQ ID NO: 93968 - DNA, 548 bp, Homo sapiens
actttacttaatttatcggtgtcttcccatgtctcgctggagtgctgcggcacaattcttcatggctcactgcggcctcggcctcctgggctccagccattttcctgccttggcctccagtagtgctgggattatgggcgtgagccactgtgcccagcccataatactttttagaggtcgtatagcacttcattatgtggatatacaagtattaacctagttaactattgttgggaagttaattaattttctcatttttcatcatttaaaatattgtaataatcttagtgtatattattgacaagttttctgaagtataattattggataggaaattatgaacatttcaaggccctcagtttctgcacttggccagtttgctttccagatggggtgtgccagtgtatacctggcctgcatgggagagtgctctctgcctctgccaaggaggggacctcctgggtcagtaggtgatggtgctgccactgtttttgcagccgttgttgagtggctgggcccaggactgcagtctccagtctcattttgat

SEQ ID NO: 93969 - DNA, 401 bp, Homo sapiens
gcttcccagagctcaggattctgccatggagacactggtttgagcaagcatactggatgttttcttgaaaaatgttaagctttaattgtttataataaaataaattcatacttattgtaggaaatgtggccagcacagatgattttaaagaagatagtaaacacccatattcttaccacccagaataatctacaaaagagcatttctttcatttctttgcattctttctgtttgtttgtgtatatataaatacaaatgcttatttttttgggggggcgggtggcaggagaatcacttgaacccaggaggcggagtttgcagtgagccgcgatcgtgccactgcactccagcttgggtgacagagcaagactgtgtctcaggaaaaaaaaaaaaaagaactg

SEQ ID NO: 93970 - DNA, 160 bp, Homo sapiens
taaaatggtgcaggtagtacagagagcaagcagtaaggagatactcctaaaattaaaaagacaattagaatatgattcagcaatcccacttctggatatatatccagaaagaattcaaagcaggatcttaaagataaattttcacccatgttcatggaag

SEQ ID NO: 93971 - DNA, 404 bp, Homo sapiens
tgagattaaaggcgtgagctccgcgtctggccataacatcttatcctatagaagcccagagaggttaggtatgtagtccctgagaccagccttccttggatgaactccaaagtgatggctgaggattagggagtgtggggtgggggctggaaagtcggtcccctattgttgctacctaggccatgacatccccatactcccatcgcctgctcaccgtttgagattcccccccaccaccgccttggtggctgaactcttactttaatttctgtctttcttcgtttgttgggtttcaggagggggtgcaggaaagacggtgtgcgtggggagggggtgtagggtggggatggaggggagcgtcctaagggtcgatgtagtgtcatgcctctttcatcaccaccacc

SEQ ID NO: 93972 - DNA, 226 bp, Homo sapiens
atggggcctattatttcccaagctaaggctctagggatgtgcatagtaaatcctttacctgcttgtatctctgaattcatgttttattgccattcctagactctaaggaattgccttattttgctgccagctcagccatgcattaactagaattttttttagaacaattctttctcttaacagttttaggagtgctaaactgggaaaaattcctctgaatgtccag

SEQ ID NO: 93973 - DNA, 249 bp, Homo sapiens
ccacctcctgggccagtcttaccgtggcacaaagtatcattttctctgggtagaaatccaggaagtcaggaagccttagggaggagggagtgccacaaaaaccaccctcacattggcctgaaacctgctgccttagtgctcttccctcccttatggagtcagatttttgtttgtttgttgttgagactgggtcttgctctgtcacccaggctggagtgcagtagcacaaacactgcagcctctaccttc

SEQ ID NO: 93974 - DNA, 412 bp, Homo sapiens
gatagaatagtattaggattggttgcaattagaaacctaggtgtaacattcttattaatgaccttcagtctttaacaaatcagcatccccttcctttaggcttcttgacaagcaatatgggatattacaggtactagtacaagaaattgttgtaactaggaggtcataattggctttattctgtgaaaaagttctggctttaaggaagcagtctgggcaatggtttggaagaccacgtgactctttataatacccactttccataatacgctccacattcacagatcgtctaactcataaatggtcagatcaaataaggctaagccatctacagtttccagagtcattatttggtaagtccaggaaagtcacatgtagcatgattgtgaagctgccttccaagcagttcctc

SEQ ID NO: 93975 - DNA, 412 bp, Homo sapiens
ttttttttttttccctgagatggagtcttgctctgtcacccaggctagagtgcagcggcacgatctcggctcactgcaatctcttcctcccgggttcaagcgattctcctgcctcagcctcccaagtagccgggattagaggaggcatacgccaccacgcccagctaattttgtatttctagtagagacagggtttttccatgctggccaggctgttctcgaacttctgacctcgtgatccacccccccttggcctcccaaagtgctgggattacagaagtgagtcactgcgcctggccagatatacctttttatcattaccatgcaaagtgtaggcttcatgccctgtttgaacatgaatgaactgaatgctatgcaagacaacccaacaccgagctgggttttttttttt

SEQ ID NO: 93976 - DNA, 414 bp, Homo sapiens
cagatacttgtacaccaatgctcagagcagcattactcacaataaccatatgatagaaaccaaccccaggtgtccttcaactgaccaaaaggattttttaaatgtggtatatcctacaatatggatgaacctggaaaatattattctaagtgaaataagccagatacaaaagaacacatgtatgatttcacttatatgaaaatgtaaaataggcaaattcatagagaccagaaaagtagatctgaagttactaggagctgggaaggttaaggtctggggattggagagtgattgtttaatgggtacagaatttctgtttggggagataaaaaaatcttagaattagatagtggtgatgggttctgtgtggagaagccaaacaataaaacaacctagtgggcaaccttcttaatt

SEQ ID NO: 93977 - DNA, 935 bp, Homo sapiens
ggcaggaccagctgcatatgcgtccaacctatgtagttgcacagtgctcccagcttagaagggcttcgagcttggtttaatattctggtgtcgccattttgaaattcgtaatttttcagaaaggggctccgcattttccttttccagtcttacctagagttacccaaccctgacacctgtctctttcttcctaatctacaagagatccctgggctactggtccccttagatgacaaaatacagaacaacacagggacacattaagtctactgaaagtttttatttccatctacttctgagattttgtatcatgttatagtccttagcctttaagaagacaaataaacttttccaatttacctcagtaagttagtagctccccacagcctacaaattcagtctcttatcattcaaaccagccctaacttttcctggccatgccccaacttctaccatcttctaccccaacttctatctagcctttaagaagactaagattctcacagacccctttgagaatctaataaaagctatgatccatcttcccaggaaaatacttctgcatctaaaattttgtacttatggggattcatgaccccagcactagagctaccacactatacactgggactgggagaagaaggggttccaggcctgggttctgagccagaaacaactaggctactgtattagcattattgctgggttaagcacagaagtggcttgccactttatttttccttcagtccccagtttcttgggaccctaacaggcatggcattcccagataaggatttgagacaaagagcaacaaactcttgagaagttggtatgacttcgagaaacaaaattccctaaacaagctatttaatctgtctaagctttattttgttacctctagattgctgtgagaaaatagagctttttaaattgca

SEQ ID NO: 93978 - DNA, 343 bp, Homo sapiens
catccaggctccaggaccctgcatgaggccaccctaccatacaggtgcctcacttaccccactcagactctgacatcctgttccagccagcactatcacctcatgacacccatgctgaccagcctgctcactccactctggctgcagtgtcctgcactagggttgccaaggctctcccagccctatacatggacagccgctttgctcagcctcacctattggctttcagactgaatcattctgatggagagagaagacaaagaaaaagaagtagagaaacagaagatgaacaacagaaggctggattttctctgcttacacctctgtttaattttatgctata

SEQ ID NO: 93979 - DNA, 420 bp, Homo sapiens
caagccaccctgtttagctaatttatttttattttgtagagacagggtttcgccttgccgcctagactggtcttgaagccctggcctcaagtaattctcctgcttgggtctcccacagcgctggggttacaaggtttgggctttcaaagcatcactctggctgtagggtggtgagtggctggtaggagataaatataaagctggagtccaggcacggtggctcacgcctgtactccccacactttgggaggccgaggtgcgtgaatcacccgaggtcaggagttcaagaccagcctggccaacatggtgaaaccccgtcgctactaaaaatacaaaaaatagccaggcgtgtccctggggtgcgtctcaactatactacttaggaggctgaggcaggagaattgcttgaatccgagaggc

SEQ ID NO: 93980 - DNA, 847 bp, Homo sapiens
gcttgttagtgagtttaaagccaatatatcctactagatattgccctacgtggtaatagtagtatgtacatcatgccctccttgaataatagagagcctattatgaaacaagcagtatagacaaatgttcctatacttatatgtttaaaaaaatgcaaaaaccatgattacttttgcacaacctaataattaatagcaaagattagaaagaatctaacttcctatcaaacgaggcccaattttaacgtacggcactggtatacagagtttacatataaatctttaggacacacaagaaattggtgatatgggttgcctccagggaaggaaaatggatcgatgagtaaaggaatgaaagggagctttcttctttcatgacttttgaagttagtagctatttaaactgcatcatctatttaaaaagaaaataaagatttaaaatttttagaaaaaaattcaccccatcacttgtcacggcaccccgttttaactctttgaataacacttactacatattttcttacactctcattaatttgtttattctgtctttccccataactgaataaagaacactcactccatgaagtagagattttgtctctattgttcaccctgtagcacccagcacttaaacaggatttagcacctagcagccactcaataaccatttgtcgaataaacctaaatcgactttgctgtcttacctcctaaacctcccctcctccagaattctgagtttggtggccttcttcaacgttttcattaacacctagcatggacctctatctctagagttctcacatggtattataattgcctgtttgtgttgggcttcggccagaaa

SEQ ID NO: 93981 - DNA, 766 bp, Homo sapiens
agcgggtaaggctatggtaaatactaacattaagctctccttatgtgccacacacagttccttcaccaaaatgggcagaattttagctgaagactaatagtgaagcctagacattcatgcagaaattaaacaactcgaccattattagaatatagtaaacatatacatgttcaataccagcatcttcttttctcactttatgttttttgaatgtcattagatttacatatcctgctaacataacataaaaacaaaccttaagtttcaagaaattaacaattctagtttcatactatttacatgtttttcttattaactattagttatttcaaaatttaccttttatgtttggagataaaaaatatctaatagaaaggtagttttttgagaagaattcatttttattatttttatttttatttctttatcttttttttgagacaacttcttattctgtcacccaggttggagtgcagtggcgtgatgttggctcgctgcgacctctgcctcccgggttcaggtgattctcctgcttcagcctcctgagcaggtgggattagagtagcttgccaccatgcctggctaatttttgtatttttagtaaacatggagttttaccatgttggctaggctggtcttgaactcgtgacctcaagtgatccatcctcctcagcctcctaaagtactgggattacaggcatgagctactgcacctggctcttttttaattattttgaaaggctactttagttttcctagtaatcca

SEQ ID NO: 93982 - DNA, 381 bp, Homo sapiens
gacaaattaagaaaattagccagtttatctgcagtatacaagttcttcacaccaaaaccacacgagcccagaataagccatgctttcttagtatttatactgttcctttcacctataacttactttcatcacttcagttcttctgccatttttgtatggcttatacatctcagttattctctaagaagtcttcacacctcaaaactacactgggaacactttctataaggtcatattgttctttgtgctgccaaacccatcatagtgtctggaaatagttcattcagggatgtgttttactaatttttctgaaagttgaacttattcccagtagctagagcttaacacagtgcctaatacagagcaggcatttggtaaata

SEQ ID NO: 93983 - DNA, 378 bp, Homo sapiens
tgctgtgcttaaaagtaaattagttacttgccgtttgaatttggaagtggctggctgatggtgaattccagttggttttgtgtggaaagttgccatatttacactaccaacttgatgtttttctttccctcgtctccctcacgaagactgtctaaacggctagtaaatgatcttctgaatctcagtattattggagacatcatagagactggataaatattatatcaaaagtactttccggaatacttctaagtattttatgaaatttattttttaaaccagggtagccaatcttttggccatattggaagaagaattgtctcgggccacacataaaatacactaacactaaaaacagttgatcagctaaaaaaaaaa

SEQ ID NO: 93984 - DNA, 296 bp, Homo sapiens
tgagggataaagcaggagcatcatacatgagtcaacatccaaggaccacatagtatctggcacatctcagaagatgcctgtgttggccgggcacagtggctcatgcctgtaaccccagcactttgggaggccaaggcaggcagatcattcgagccccagagttcaagaccagcctgggcaacatggcaaaaccccatctctacaaaaaagtataaaaattagctggatgtggtggctcacgcctgtggtcccagttactcgggaggctgaggcaggagaatcacttgagcccagga

SEQ ID NO: 93985 - DNA, 312 bp, Homo sapiens
ctaatataaataatgccagtgttaacacaaaaatttgacttgaatgattacaatagcaaacttcaatgtttaccccatggaataggcagaaaatttcaagcacttttctaggccacctgagtctattttgagtaaggatccttaagttgatactcaagtaatgacattgatgcaatgtagaagactatgctaaaatttgtcctggcttctctccatgctatgggccatctgtaaagctttggagtctaggtcagatgtatgcgttgtctcctctttgctaccatttttgtacagatttctaatctaaataaa

SEQ ID NO: 93986 - DNA, 1813 bp, Homo sapiens
  misc_feature (824)..(824): n is a, c, g, or t
  misc_feature (1379)..(1379): n is a, c, g, or t
  misc_feature (1713)..(1714): n is a, c, g, or t
aaggagccccacacagtgccttcccccaaccatgagccaattctgtcacagtccgaaatagactttttctaagggtttcgtgtccctcttttatccgtcgcagtgtaaagggtctgatccgcagcctgcattgtgcgcgcaccgaggcaggagcggatgtcttctgaggagagcgctggctggggttgactctcaggctcccggctgtccgcccgcccacacgcagcgaggaggggcggagccctgcttccggaatgcttaaaatatggaattctagaacatgacccacattctgagtatcactccagcatctgccttgtgttccaagtgggaaaacgagaagtgcaaaggaacaggcagcgaggagggtagcgatttttgtctgcaaattgatggagctgatgcaggtgtcccctttgtaggcgagccctccattcactggctgctcccagcgctgcctggggagggaaacagctgtactgctctccgctgcaaaactcagatgtgctttatggcttgtgacaatagatttcctccccaccacgcttcactgggacacttcaattccagtaatatatgtctcagcccttctgtttactgcgccctgctcacccccctgggctgtcattagctgcaccaccatcaaccgtttcttaattgacctttttaaaatgctggacatcaccggctgcacgcagctgccacacattaaatttccagagcaaagagtccaacttggtagctggtgaattgcagccctgtaatatacttaataaatgacgtccacccagccttagtccctgagctgtcaggtgaacccgtgncacgtctcaactgaatggcacaacattcatgagaggaccataccccttctccctgtttcttgcatgaattaaggaagcagcggatttccaggatgatttcctgtcaaggttggctgcagagaattcctgccatcttggttcatgagatgagatatgacatcatcaaaggcagccaggtcccaggccgttcaatggggatcctgcattaggaagggtttgcacattaaaactgtgcctgtgccacacctctttccttcgtgtttgcatccctgccctgtgaagtaaaacagagtccaagatgcaaggagtagattgtgtgtggggtggtgaaaggacacccctggcagccaggcagagcatcagtgcctcccttcccaggtcaccagcttgggacctccttgtgagaggctctgatctccatcagcatcagggcccataggggattctgaactcttggaggatatttcatcccctccaagccttgccccatggaaagggctacacctcctgcaggaaggggtgccttttgttaacaggtattaatgggtacagagncaccatgcagcctaccagcacccttgctagcctagtcctcttcctgtgcttctttttgaaagatcaagaatgaagaggaagagatgaggagtgggggtcctttacctaaaggaccctcgtggttcattgcttctctttaactgactttttaaaaaaactccctcttccacactccttgctgtgattctgtcctaatcatttttcttgagaatgtcatgtagagataaatgtgtgtcacagtgaagccagaaggtgaattaacaactaagacaaatccagcatgctcttgcctgccctgcatatgtgctcatttggggaaggacggaggacacanngcatcgacacaaattctacagctcctcagagaacacagcagagactcagatgagctgtaaaatccattaaggaaaaataaatggcatgatttggaagtt

SEQ ID NO: 93987 - DNA, 327 bp, Homo sapiens
ttttctttagatcatactcctctcacacagcctgcagaggacacataggctttcaaagctaactgagctccaaaaaccagaagacttaaaagatcttgccttccggctgggcacggtagctcatgcctgtaattccagcactttgggaggccaaggcgggtggatcacaaggtcaggatatggagaccattctggctaacatggtgaaacctcatctctacttaaaatacaaaaagttagctgggcgtggtggcaggcacctgtagtcccagctacttgggaggctgaggcaggagaatggtgtgaacctgggaggtggagcttgca

SEQ ID NO: 93988 - DNA, 419 bp, Homo sapiens
ggggggagtctacccatacaaagcaatattattcagccataaaaacaaatgaaggcctgacacatgctacaatacagatgaaccaggcacaaagggtcacgcattgcagactccatgtgtataaaattctcagaataagtaaacgtagaggcagaaaacagcctggcaggtgccaggggttgggaatacagtcatgtgtcgtgatgtgtcatgactatgtgaatggacaccagagtattttttcggtgacaaaaatgtgttaaaagtagacagaagtaatagctgtgcaacattgggtatgtactaaatgctctgagtttttcactttaaagttaatggttatttttatgttatgtgaaattttacctcaaaacacaaatacacacagaaagagagaaatgactttttaagagcaaaca

SEQ ID NO: 93989 - DNA, 757 bp, Homo sapiens
actcaaactaatctttgtcatctattttcatgtttctacccactctatgttttagagttggaatgtattgtgactgaaagttacctaattatttgacctatgcaagaatattgaaacatctcttggtattgatctatttcacaagtcagccaatttcttttttggatatctttttctattagaatatttttcatctctggacgtggtggttcatgcctgtaatcccagaactttgggaggccaagatggggaaattgcttgaacccaggagttagagcccagccctggcaacatagtgagacttataaaatcttgacttattgagtacacctgaataataaatttatattctctcttgtcaatcatcaaggtataatgcatagagcagattttgtttctccatcaccaccttttagtgttttaaatagtagtgttgcctttctggttctgcagttttggtggaaattttccatccataacaaacagtcctgattaggtaattcataaaatttattattttctaattggaatattgctattcatacactaggttcatgtattttgttggtttatttgtttgtttagaagagtaactcatgcttattgccaaaagtttaggaaataaaagtataaagaagaaagtatgtattgcaagtccttactccctttaatctaaccaccattaatggtgttttctatatttatgtacattctttaacaaaagtggaataaaattatgtttgctattttggaactt

SEQ ID NO: 93990 - DNA, 171 bp, Homo sapiens
taagtactggctctgcccctctctggctgtgtggccttgggcaagttagtcaagtctgtaccttttctccctctgaaaatggggatagttatagtactaatctcatagggctgttgtgaggaaggaattaatcatggaaagcacctaaaagagtgcttggcacgtagcctt

SEQ ID NO: 93991 - DNA, 685 bp, Homo sapiens
caaaagtgctgggatgacaggtatgagccaccgcgcccaacctattttgtaacctttttttaggcagcagtttccaccattttgtttctgtaaattttcagtgcatttgatactctgatcatgttcacttttctccagttgtcccaaaaatcccctttatagatggtgtgtccaaatcagtttgcaatgcagagacacactttacatgtggttgttatgtcctgccagtcagtcccacccagcccctttgtttacgttgaccagtagaagagcctgggccaggagtcccgtggaatgattcactgtctggctctgtctggttgcattctcatgtggtgtcacttagctcattcctctgtcctctgtattttctgtaaactgaagttatatccaaggcgtgatgggtttcttggtgcctagaatagctagcaggtgtcggtgtgtccttcctgcggcatcccaccaccattagtggggccaaggcctattctgggatgagggggaagacagtgtgacctctccctcatatggttgcttatctcctcttgtgagtggaaaagtattatgtgagggttcccttggcactgtctaaatgccagttctgggagatctttttaaactacacaagaaaacttgtccatttgctgagaggaacttgatcttggggatagggcacttgggtaaa

SEQ ID NO: 93992 - DNA, 435 bp, Homo sapiens
acaggctgcaatcaaggtattgcccatgctgcattctcatctggtggcttgacagaggaagaatctgcttactcaaggttagtattatacttaccctcagcaataaaatacctaagaatgctttaactccgattatccttcctaacaagttataagcttttaatgtccaatattttggctccattttgttttttaaatcacccaagttgacattaataccatttatttacaaactgtttagatttatccatatgtgccatattctttgctcactattccgtcttgcacctcagaccttttgtcctggattattttccttctttctgaagtatattttttagaagttccttcattgaacatctgctcatagttaactctaattttttgttggataacatctttatttttccttctttcttgaaaaataatttctcc

SEQ ID NO: 93993 - DNA, 933 bp, Homo sapiens
  misc_feature (754)..(754): n is a, c, g, or t
  misc_feature (757)..(757): n is a, c, g, or t
ggtcccgggactgggaagaaacggcggccgggagggggctccgtgggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagacaccacatggtgcatccagggctgcagcgccgtcaccggggagaacctgctgccgggccatcgactggctcctggatgacatttccagccgcattttcacaagctgactgaaccaatccagatgcgcccagctagcagtccaggtccctcaacttcacaaacatacccatgggggttgcgagtagcggcaaatacacatcgccctctcacccagctggtgtgtattgtggccgggtgtctgggcacccggtccatgnggnagggtggctggtggtctctggccgactgcctgggtcacaaccacaaaagggcggcgggagggaggacagagccgaggggggccaccacccagtaaacggtggccaaaaagaaaaaaagtgcgggggcgagaattaaagggggcgcggagaagggggtgaggagagagaaaaaaggg

SEQ ID NO: 93994 - DNA, 646 bp, Homo sapiens
ggtcccgggactgggaagaaacggcggccgggagggggctccgtgggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagacaccacatggtgcatccagggctgcagcgccgtcaccggggagaacctgctgccgggccatcgactggctcctggatgacatttccagccggccaaactaacgctccccctcctccaccccagcctgctgctgctactgctgcccgctg

SEQ ID NO: 93995 - DNA, 302 bp, Homo sapiens
ggtcagtctttttaataggtgtgtgctggaatttccttgtaattgcaagttctatttctctattaactaatgaaattcagcattttaaatatgtttatttgccattcatatattttttttggtaaagtatctgcccgctttaaaattaaaaaaattattgacttttgagagtttgagaggatacaagtcctttcatttatatattctagatacaagtcctttatcagatatatgctttacaaacattttcttcccatctgtggattgctttttattcattttgaattagtccagtttttcaa

SEQ ID NO: 93996 - DNA, 405 bp, Homo sapiens
aaggcgctagcatctcctaggctaacagtacaatttcggctacctgtaattattgaattcccattaagcaactacactgggaatcctgttattaaccaatttatcacaccaaggaaccatgtaatcacagagtaatctaatctgagttcttgttaacaaaatgactcgactttatctgtcgagttgattcctgtttgcactccccattatgctgccctgggaatctgcaaccagaggcaggttccttggtagagggcacttatgagtctgtgagtgcccacttggaaacgcctgccagcaagttgaccctgaggtccgccccccagcccatctccccatctgtcacatgtgagttgcagtggatctgcgtgtgggatgacgcccgtgcaccagccaggcaacgtg

SEQ ID NO: 93997 - DNA, 722 bp, Homo sapiens
ttagctaatttttgtgtttccccaaactggttcttagaaatccaaggccttgacttttaaaacttgtctctgagttttaagggctcattttggaatgtaaaagataatcactgtttttcattgttttggtgttctacaatcatgatttggggtcatgagaaaacctcattgtcctggagtgaaaataatttgagttttgtgcttcaagatttcattccacttctttgagtatttggataaatgcccatgaattaagtaagaaccaatgagagccttagagtcatgatttctttatttaatttttcagctgcttctctttgcaaacaacaacaacaaaccaaccccaagcccacagatggcgttagtcatcctaataatacacatcaattaaaactgtgagtcgggatccagcctcatttgctttgagcaacaggtatattactgacgagttgcagatacattgacattttctaaatcaaattaatttttaaaggcactggagtagcttgcaatttaaaggtaattgatattaaccccctgaaataaagagttatttgtaaagaaaaaaaaaaaaaacaaaaaaaaaaaaaaaaaaaaaaacacaaaaaacacacaaaccacacaccaacaacaacaaagacacaacaacacacaccgacgacccaacacacacacagacacgacaaaacacacgaaacaccagacaccacaacaacaagaaa

SEQ ID NO: 93998 - DNA, 394 bp, Homo sapiens
gttttcatccagccatgtaatgctctcccatgctggctttcaaagttccatcatctactcgaagaagagaggaaggagaagacctagcaaaaccccaaggtatttagattagccaaagggagcatcactttgcttaagtggagtgaattgttttcctctagtcattctttcacgtgtaggtgactgttctcactgctaatgattatgcagctatggagatttcagcgaggagcccatccaccaagcctggctggcatttgagttatgatggaaatctggtgattttctgttgcagtcatttgttgttacaacgcacacagatttcactcatcgccaagtgatttcatgaacaggaatggaaacatcgttggcccttatcacagagaggtcctgg

SEQ ID NO: 93999 - DNA, 288 bp, Homo sapiens
aacccctgaccttgtgatctgcctgcctcggcctcccaaagtgctaggattacaggcatgagccacagcgcctggccgcctgttcttaaattcttaagtcacttacttgtaatgttttgatgtatttgttgattccttcaggtggctaattccatccatttgtatggctgttacttgtttcatgttatttccaggttgttggacaatacttcacagtaagccccatattgtacagactttggaaccaaatgatctagctttgaatgtggctctgctacttactagttc

SEQ ID NO: 94000 - DNA, 613 bp, Homo sapiens
tggaacctcagaaactaagaggatactagataacacagaatggaaagaattatgcagattttagaggaaactgtacattcctaggaggtcaagtccctgtggttgatttttttttgatatgttttttaaatgagtggctaatgtttcttttgcattggaggccagaccactggaacattaacatttcaatatttgaaactatgtttttcattcaatagcatgtctatagagcctaacacagcagtctaaggaagaggatatgcttagtgaatatttctaaatgatcattttattcattttcttttttaaatgtatttatgcagcacaaaaacagcataccacagtcgcattaggtgcttgaaataatttggagagcaaatcagttaaaatgactagaaaggaatgagacaatgtctgagataagccctgatattcccatttgccttgtccaaggtagacattgataattcatcacagtcctctttcctgctgagcctggatgcagcatcagaatcctcctcaatacagggcttccatcagccactaccaatcagctggagttggcagctatttccaaaccatttgccactgttggactagactgtatttccct

SEQ ID NO: 94001 - DNA, 153 bp, Homo sapiens
ttcatgtagagaataagaaaaaatatgtttattacctaatgatgttcaggtcattgatggtttcgatgactttttggccttagttgcaccactcagaatactggttagagtcacttggcatattcaaagtaagacagccttatgttgcgactg

SEQ ID NO: 94002 - DNA, 148 bp, Homo sapiens
tatgtgagactgggagtggatccttccccagttgagccatgagataactagagccccagctggccctttgactacaacttgtgagaggctatgatgcagaagctccagctaagccacacctgaattcctgacttacagaaattgcaag

SEQ ID NO: 94003 - DNA, 549 bp, Homo sapiens
ctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgtcacccaggctggagtgcagtggtgtgatcttggctcactgcaacctccaccttctgggtttaagctattctctcgcctcagcctcctgagtagctgagattacaggcaaccgccaccacaccagactaaaaatacaaaaaatgagccaggcatggtggcacgtgcctgtagtcccagctactcgggcagctgaggcaggagaatagcttgaacctgggaggcagaggttgccatgagccgagatcatgctactgcactccagcctgggcgacagggtaggactctgtctcaaacaaacccccaa

SEQ ID NO: 94004 - DNA, 327 bp, Homo sapiens
gtccttttctatttgagtgcttagagataacttaaaactaactctaccatgtcgtagatataatttttaaatttaggcgtctgatctatattattggtagaatattccctcatctgtaaaatggtgatgataataggacttccctcagaggcttttataggagtaaaaaaagataatggataatgtatgtaaagggcttattactatgcttagtgcatagtaaaaggtcaactaatagtggagggagaatggtaggatattggtagaagaaaatactctcttccaagcaataaataatctgtaaattctcagggtgatgtatatatt

SEQ ID NO: 94005 - DNA, 371 bp, Homo sapiens
tgaaacagtgtttgtattttgccttggagataaggacaaacatgagctggcaacccacaatctttattttcatcagcttgctcttcagcaggcctacaccgtcagcactgtgtgaagagcgaaatcaataaaaatcatctccctcggtgcaggaggccaacatgtgactgtttcttggctctggagcaagtatctgtcagtcagggtcaggaaggtttctactgtacttatctgggcaatctcttaccacagtgtaactgggcacctaggggggctctatagatggggaaatggaagctttgtggtgtcaatgccttaattcaagcagcctcagctatgcaattcacccaacttagaagacagcattaact

SEQ ID NO: 94006 - DNA, 381 bp, Homo sapiens
  misc_feature (27)..(27): n is a, c, g, or t
gggtgatctacaggattatccccgganctgggtagctgggactacagcgtgcacatcatgcccagctaagttttatatttttagtacagacagtgtttcaccatgttgtccaggctggcctcgaattcctgacctcaagtgacccgcctgcctcagcctcccaacgtgctgggattacagatgtgagccaccatgcccagcctcatttttctggctcttgaacacacttttctctttacctggatgccccagatttcttttgtcagcctaaggaatatgtactcctattattaagacccaactcaagtactttctcttttctctctttctctttcccaagccaagtccctcggacaggattgctcatgctctcctatgtcc

SEQ ID NO: 94007 - DNA, 233 bp, Homo sapiens
cccgactagcccgacagcatagcaagatgtactaatgaaactgttaacatatgtagcggtcctgtagcctggaataaactctatagttaatcatattttcctttcttttcttttttgtttctttttggagacgtagaagcaaattacaaaaactagccatactgaagggaaggagaattaggctccacttactgaaagggggctgcccaagcatttgtggatatattttaaaa

SEQ ID NO: 94008 - DNA, 1243 bp, Homo sapiens
gtctacacctcctcactctagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgccagactcgtgtgcctctggcccctgtcacaacggcggcacctgcttccactacattggcaaatacaagtgtgactgtcccccaggcttctccgggcggcactgcgagatagcccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttggtgattctgtgggccc

SEQ ID NO: 94009 - DNA, 220 bp, Homo sapiens
atatctgtatgccaaactagagacacgtgaacggcacaggtgaatggaaagcaagccaagttccccatctagcatatctgcaaatatgatcgagaatgatgggagcttttccaggcagatactgctaaacagggaaatcaaacatgggtggaatacatttattcattcgtctattataatcttatcaactcctaccatgcaaggtacttttgcttataag

SEQ ID NO: 94010 - DNA, 412 bp, Homo sapiens
tgcacgcagaagacagtggagtgacatcaagtgctgagagaaaacaaaacaaacctgccaacctgggatcctatacccaataacaatatctttcaaaactaaaggcaaaacaaagactttttagacaaacaagagctgggaaaattcattgctagttaacctgcactacaagagatggaggaagtgtgttgggcagaaggtgtatggtaccaggtgacatttggatctccacaaagaaatatagagtacctgcagtaatgtaaaagccatcgaatgtaaagacattgcatgtctaaagccaaaacaatgcaaatatattatgagatttagaacatgtaggaataaagcatatgacaataatagcacaaatcatagacaggacatggaaatgtaaaatgttatttagaggtag

SEQ ID NO: 94011 - DNA, 266 bp, Homo sapiens
agatagctggctgtggcaattctgacgtcacacacaggcaaggggtaaagtctggatttttatatcattatagtggttatgatgaattatgccatctccttcatttagcatggcagagtttgcctgagtttacacgatgagctttctgttatgaaccttgactctatctattgcataaagggaatttcctgatttttattatttatttatttagagccagggtcttactctgtcacccatgctggaatgcagtggtggtatctcag

SEQ ID NO: 94012 - DNA, 473 bp, Homo sapiens
gataaagtcatactctggcggtggagctgatactgacaaggataatgaacgtggagaaggagcacatcgcagggcaaagaccactgacctgaccagacggtggggaatccagtctgcagaccggacctagctcaaacttctgtatcaggttacagacgatggcagagctccttcactcattcattcgcacattcaatagtgaacttccacaacgtctgcagcccagcaaccactggcactcctggtaacgggtatctgtgccttcatttcttcttaagggaagtggccacctcctagctcagcccagatgccagcccacacattccatccaccaggtgacaatgattggttcagggatgagcacgtgaccaagtcaggccaatcagagctaacaagacccaattctggggtatctgttctgggctattgggaacccatctctctctatcaattcaggatctatctatctacct

SEQ ID NO: 94013 - DNA, 379 bp, Homo sapiens
aactcctgaccttgtgatccacccaccttggcctcccaaagtgctgggattacaggcatgagccaccgcgcccggcctaatttttgtatttttagtagagacggagtttcaccatattggccaggctggtcccaaactcctgacctcaggtgatctgcctgcctcggcctcccaaagtgctgggattacaggcgtgagccactatgcccggcactatgtgggaagattctaaagtgcattccagaggccagtgtccctcagaatttttcttcacagtgctgatcatggtgggtgtgatggttaattttaggtgtcagcctgactgggctcagggatgccgaggtagctgataaaacatgatgcctgggtgtgtctgtga

SEQ ID NO: 94014 - DNA, 300 bp, Homo sapiens
gttcttcctaagtttaatcttttccatgtggtttcattcatttatgaaaaatatgaccacacataccaatattcacccataagactcacatgtattgcaaaagtcagagagaaattttagggcacttctcaccattgctctttttcaggctagaggacaactgatcacacatactgtgtgcccctgcatatgcagctctgagaatacaaagtgagtagtaggagcttacgatctctacctagggagtatctcatcctctgccgcttctccctttttacccacactgacatcgtgtgtctg

SEQ ID NO: 94015 - DNA, 584 bp, Homo sapiens
aaagtgctgggattacaggcatgagccaacatgcccggcctcatttttctttattctttttgcttctcagatgcaataattttaaatgacctatctttaagttcacttattcttacttctgtttcttgagtctctcattgaatccctctactgaatttttaaattgtcattttatttttcagctcaaaaatttttacgtttctttattatattttttttaacttatttccattatttctgtttttctcttggctttagcataaaacagctatgttattgtcttgtaagtaagatctttatatttctacaggaagattatctggagacttaatttgttattttaaaattgactttgtttttatttttttctgtttctttgtatgccttttgatcttttgctgaaaactgggtttttgaaaaaacatacaccttcccagtctttcaggactggcttcatgcattagaccatcacacattagcaggtcatgttctgtgcctgaggtcagctcagtataaaggcttgatgtattcttgggcatttctagggatgcgtgctttccggatgtgtgtgtgcgcgtatgagt

SEQ ID NO: 94016 - DNA, 432 bp, Homo sapiens
agggctggagagggatgatgagaacaggcaggtcccctgactcctgccaagcgtggctgccccaccatgccgcctcgttccagttgtcttccctttcatccttccacatttccagtcattcatgtccatcctttagggacaacagatactagaaaaaaaatcaacaaaaaaaatttttacatatatttttgaagtctccagaccaaatgctaacacctgccacctaaaggtgagtacctgctgcccattcttcagcagtgtaaatttactaaagggtctttggcgtttgtgtgtttggagaaactttagtcgaggacaaatccttattattaggttaaatatgcttcttatgtgattataatagttgcttaccctgaatgagagattatttatactaagaaaacaataaaaactgtcaaagcctaaaaaaaa

SEQ ID NO: 94017 - DNA, 258 bp, Homo sapiens
gaaaatttaattgccaaagcagtatagcacagtagttcaaaatagaactgtatttgtatataatctctgccacttaaaaaagatcttcagtttttttttaacgtttctgaattaattttcctctttttaaacatgcaaaaatacttccacctacatcccacatgtaaaggctattacattgtatcagatagtttctttctctggtttccccttaatcacatttctgttctctttcatatactctggtttatctgattt

SEQ ID NO: 94018 - DNA, 649 bp, Homo sapiens
atgtttctgatgcaggaatacagctatctaggaacaaaagggagatgagactacagaacagactgtgaaatttcttaaaattattaaatgatcctaagactgagcacaggagtggatgatgttactgcagattgttcttaataagggctttaaaagcttaatgatttattgattggctctgcattaatgacgtgcccttgattatgcatgtgtaaataagagggctgatttatgagggtacaattgtatctttcagatatatttgtccaagtctacatctttaaaataaatggaagcaattatctgaatatttcaagggagggaaccccaccttcccatcccccacccccgatttgagggaagtctagtatgttaggtgaagagaaaaaaaaagaaaagaggaagctctaaagggagttaggaacaaaacaaaacttccgttaagaaatatccctgcttctcttatcctaagagaagaaaaacagattcccaggtgccaccggggagcaatgttttacttaaaaaaaaaaaaagaaaaaggaaaaagaaaaacctgtaagaagttgtcctgttaaatcaacgacacatggagtctgaaggaaatcagccttttcgttacaaacaggtttaaaaagccctggagaagaga

SEQ ID NO: 94019 - DNA, 247 bp, Homo sapiens
agattcgtctctgggaagagatttacccagtagagatcagagccggacattttattgttttccaagtttgaccttttcatttcaggagcatcaagcatgaagagccaatccagtttaagtgtgggcatcttgagagtaacactgtgtcttgttccttcttgtgttcctgctattgactgcaatgctcagtaaatgtttcaggcatccacgaatgaatgattgaacaaatcaacaattaatcaattaa

SEQ ID NO: 94020 - DNA, 263 bp, Homo sapiens
tacaatgtccctgacgggtggtgaatcaagccctgctttaacacctgatggtgacaggtgctcattccatggggcagtgtgttctgcagatgggtgtggaaggtgctcagctcctgctgagagaagccctggtggctctcactcactgcttttagcttctaaagcaacacattagaagtctactcacttctacatgacagcccttcaaatcaatgtttggaaacaacaatctggtccttcttcagacatccccgctccttgta

SEQ ID NO: 94021 - DNA, 466 bp, Homo sapiens
ggctgggcacctaatgggagagatttgctgaggctcaaagcatgatagttccttaggggaagcacaccatgttggcagaggtactgggtcagatgtcttgccatcccattgactggaagacccagtcctgagaagcaaagccaagaccctggggccctggaggctcccacaccttcctgagcccaggactaagactccatgattttcctaataaaccagatcactccccagggccagggagcttctaaaggggcctcctggccttcccacctgggctgggctttgctggtagaatccaaacctccaatgcctgctgaacgtgaaggcaaactctcggctccactcagctcagtgtggcagaaacgaaatgcctccttttcccctagccctttatcccttcctttcttactttcctgtatcccccacattgactaccctttctcctcgggcacttaacaccagtcca

SEQ ID NO: 94022 - DNA, 221 bp, Homo sapiens
gcactactaagacactgaccctgtactcagaactgtaagctttcctgggttggaaaaggctctgactaatttgcacattaaaaagcacacagacagaggaacccacctttttttccctttcccagtcaccctgggagagaccgtcttctcttcttcattcatgtgtggaatcccaattaagcgtagtaaacaaaggaaacttcttacattgtgattttcct

SEQ ID NO: 94023 - DNA, 558 bp, Homo sapiens
ggcagacagggctctgaggcgcgcctgattggacaataagtaggatgccatcctggcacccctaactggatataacttcaggctccgcccctgtggcttaaggggcagaacacttaagatgtttcaacagggatccaacgtggttctagcacacaccgtatgcagtggtgtgccttcctccaggttccagatacccatgtccaaagtcagcatcacatattacatgcattaaaatttttaaccaatgcaaaaatgacaataagccatacctatatctttacggggaatcattattgttaacctcaaaaaggcaggactgtctatattgctatgcactatctacatccacacttaagcagttcctgaaatggtgctgaagatgtataagaggtggaaatataaatgaccgatggtgacatttcttcactcactgatgttgccaccctccacagagaacatatacacacaccctcagcttccgtattatctcacaccatcatttactttccttcaaagtgcttatttccttcttataaaccagtcttaccattttttcaa

SEQ ID NO: 94024 - DNA, 260 bp, Homo sapiens
acactgtaccccgtgaatacatccaacgattatgtgtcaattaaaaataaagtaaaactttacaaaatcaaatgagctactctgaagcatttgcaatgacttcatagtttaaactgggatagaatctcaaactagaaaagggcaaggagcctgttctcactaaccatgtcactcttggagcagatggcctttcctgaaggctgcgacattttttgcatatccctttatttcaaaggctgttatggtcatgaaatggaata

SEQ ID NO: 94025 - DNA, 158 bp, Homo sapiens
tgttttgtttttgtttgtttgtttgtcttttaaagcaaaccacataaaaggatttacaccaaaaagtcagtctctcccatccatggcccagttcctttcccaaaggcactcaaccgcagccacgggttccatgcagaccgtgtagagaatcatagatg

SEQ ID NO: 94026 - DNA, 306 bp, Homo sapiens
agacattccaaagatgcaatcaacccaaatctgttattatttgatatgggtggctgggcagagggaagggtcaaaaaggctcccagcttctagttcagtcccggggaagtgatagagctattcaaagaagttgtagtgagagagagggaagatgacagtttggttttagttgatgtgtacagaaatacgggtgcccaggagcccacaaaacggccagaggagaaatgctttcaaaggcaagctgcagggctccttggttttgtcacattcctcattctggggctttgcggttttgtcttgggaatc

SEQ ID NO: 94027 - DNA, 399 bp, Homo sapiens
ctgggtgtcctacaatttaattcaattctgacactaactattcagttaacacagactccacaggttgatgtctcagtcccacaagactgtcccgagttcaaatgccaatctcaagtagtgagtccccaggtaatccacacttctgtgcaatttgactaggggttcacatgcaaattaagggttcacatgaccccttcctcagattcaataatttgctataacagctcatgtatttcagggaaacacttttgtttactggtttattaaaaaggatattgtaggctgggcatggtagctcatgtctgtaattccagcactttgggagtctgaggtgggtggattgcttgaggccaagagtttgagaccagcccatgcaacatggcaagaccctgtgtctac

SEQ ID NO: 94028 - DNA, 340 bp, Homo sapiens
tcacatttgccacaaggagattaataacgcgatgtgtatgacagcctgagaccttgattgaaattatgctctttctctctgagctgtgaatggggcatttggggcccttttgtttctggggggtcatgagaatcatgggaaagggagaggatctgtgtagtgtgacgggtaccgtgtggtggcgtccccttccaggccaagacccactggagacccttctccacaggcctgggcttttctgggcgctcctgccacaggcgacagccctcaatcgcagctcctgtccccgtcagtcccttgtgagtgaggggcttgcccagctgtgctccttctcattcaa

SEQ ID NO: 94029 - DNA, 639 bp, Homo sapiens
gtttgggccatttgtcgccatgaagcctgactcttgaaaaaaagaaattcttagccaagtctctaaatgacgctgtaaattaaggcaaaatcaaaaccagaactcaagcctacactacagtaaaaaccatcacatcatactctatttcttctggattatttcttatgcttctctaattttcatttagctcttacaattaagataatttagaaacaatcatgagtactttggaaaccttaacttttatttacagaggagagaattaaagagttcatcttaggaactaaaacagctagtagaacctagagtgtctatgtagttttgacttctacttcattattataaccattcatgagtgaaatctacatatattacaactgtcattttatgctttcctgttaaaagaactttaattcctctatgagacttgcaaaaattaaactatctttctttcatggcatcaatttgcaatgtacttttatattgaatatctagaagagtaacaagtaatagctgataataataagagtataacaataattgacaagttaaagcttttactttgtactaggctctgtgctaagcagtttatatgcattgtcacattgcaagatacagacaataaaatgaaagaccaga

SEQ ID NO: 94030 - DNA, 151 bp, Homo sapiens
tccatgggccttaaaaagcaggctaatttactgccatgtttgcttttagctctgcatgaaggataaagaccctcacagtgaaacagctctgtaagtactctaggccgggaccagtgctttttaaataagcagatgaatagcagtgatatgc

SEQ ID NO: 94031 - DNA, 452 bp, Homo sapiens
tatggaaagagctattaagaatgaaaagtaagattttgttaagtcttctccttgaagtatatgttaattaattgagatttgttccaaataggttggtaatcatttactgtttagtgtgttttttttctaggtaggagatacttgggtctcacaaattggtgcaaagccaaaaaaaaaaaaaaaggaagaaacaacagagtaatcaattttttaagttgcccaggaagcatataaaaaataccagttatgccaggtgtggtggctcctataatcccagcactttgggaggctgaggcaggcagattacttcaggccaggaattcaagatcagcctggccaacatagtgaaaaccatctctactaaaaatacaaaaagccaggtgtagtggcatgcacctgtaatcccagctacttgggaggctgaggcagcagagttgcttgaacctggtagg

SEQ ID NO: 94032 - DNA, 1125 bp, Homo sapiens
gaagagcagtgtcataatgcaaatgggaagatttcttctcttagtaattttatttctgccacgtgagatgacaagttctgttttaactgtgaatggtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattccagctctgtctgtgtctcttccatcagtgaaaatgacaacggaatcagctttacctgcaggctggggagggatcagtccgtgtccgtttcggtggtgctgaatgttacttttcctcctctcctaagtggaaacgacttccaaacagttgaggaaggcagtaatgtgaagttggtttgcaatgtgaaagccaacccccaggctcaaatgatgtggtacaaaaacagtagtctcctcgatttagagaaaagccgtcaccaaatccaacagacaagtgagtcttttcagctgtcaatcaccaaagtcgagaagcctgacaacggaacctacagttgtattgcaaagtcatctctgaaaacggagagcttggactttcacctgattgttaaagataaaactgtgggtgtaccaatagagcccattattgctgcatgtgttgtgatctttctgacattgtgctttggactgattgctagaagaaagaaaataatgaagctctgcatgaaggataaagaccctcacagtgaaacagctctatgagaaagctgagatgccatcgaatacagagagagttttgcatcaggacctccacaatttatgtagtcccatctgtatttattgctattattaaattcactcctgtcactcctgtttcattaatcacttaacagtagttgttaggactaatttgatacacttgtggaacatttttatggaaagagctattaagaatgaaaagtaagattttgttaagtcttctccttgaagtatatgttaattaattgagatttgttccaaataggttggtaatcatttactgtttagtgtgttttttttctaggtaggagatacttgggtctcacaaattggtgcaaagccaaaaa

SEQ ID NO: 94033 - DNA, 402 bp, Homo sapiens
gctgcagaccgtcggctgctatggctgggaagggataggtaggaagcagaataggctacagacaagcggtggggtggcctgtccagtggggaggggatatttccatagtgtcagatgttgggccatcaccccacagaaaggaatgtggtgaggtcactgatcacagcctggaagaaatgatagccctcactagcccagggcctcacaccacatccagtggttttctgtgtgagactgtagaatcctgcattgaacttaacctccagctgagtcaaagaccgtagagctttcctccttctagaagtggagctcatctgtctagtgccattggttggttctttctacggcctacccatgccctagcctgcagtgggtcagctcttacagggtgccctgacgttg

SEQ ID NO: 94034 - DNA, 444 bp, Homo sapiens
tttggccaaaacctattacaaaagccctcaaagcagcctcctgtgatgtggaagctccatttctctctggagctggaatctcccggagtgactacctggggcactgggttctgtgtcagcaggttccagcattcagaaccactggcagctccgagggcatctttgagcccctcagtaacttggcatcctttagcctacaagttactccatctctgaaagaactaattctttggaagacttggaaagtacagtggctacagcttctacttctaaagtctgtggctaggccgggtgcggtggctcacgcctataatcccaatactttgggaggccgaggcaggcggatcacctgaggtcaggagtttgagaccagcctggccgacacggtgaaaccctgtctgactaaaaatataaaaattagccaggcatggtggcgggcgcctg

SEQ ID NO: 94035 - DNA, 381 bp, Homo sapiens
ggagcaccagagatgaatagccccaagtgctccctctttggggttcccaaggcaccctgtgcctgcttccctcagaggaccttccaatccatttgccccgcaaccctggctgctccgacaggggagacttgtctcccttgttcccctcaggatccatagagtggacagtaaaggtgctcagtacatgttggctgagctgaactgcatacatgtggcccccaggttcctggtctttatggacgaagggcacaaggtggaggggggatggggggatgctgctggaggtctcagtgggtgcagacagccctgccttgaggatggcttgacctgggattgacaaagtgtgtctgctgaaatgctgaggtccccacgtgtgaatgg

SEQ ID NO: 94036 - DNA, 923 bp, Homo sapiens
gaataggcctttgaggtctgggattctagcagtctcctttctggtttccttccctccccatcatcactccagtcccccacaaatccatgtgtctgggctaaaagagatgttggcccaaaagagatgttggcccttaactggtgagttgatgtagacaggacctgtgatgcttcctgaatcagtctgtgaggcattgctagtgaatggtatctgtggttgatttcctgagtgagcccttcccatgagagtgtctcctcgagtgtccccacaggccgatctttcatttgtttctgctttacctctggcttcctggaacagttctgttatgtgactttatagcagcgctgagagctgatggtaagccttctgagacacagaggcttgggtttttacgtcagtggcccttgtaggccaagggagtgaaaagtaaaggaattgagataaaatgctgtccttgccaaattgtggtttctgctttatctttcaagaagtctccattttctcttaagtcacagttcccagaggtgcatgtgggggttccagtgacctttcatgtgtggttcctgtctcagagaatggggtgcaaaaagcccagcgtagttaagcttttcagattttatattctgtgctttattacagtcatacaaattttgtaacccctgttaggggctttattaatgtatttatttgtaatttagacttacacattgatggcagacactttcacttttagttttggtagcctctcagcttcctgtctgaaaagttccagacttactagtttttgttgattagaaatcacatctgttgcttcctaagggccaggaaactcacccttcccatcagatcacttgagtcgttgttcctctcattaagctgtaatctgtctcctggtctccaaataaagacacaaacaccgaaaa

SEQ ID NO: 94037 - DNA, 693 bp, Homo sapiens
caaatagagaattgatagattttaggtctttaaggtaaataatacctttaacttacaactttgagaatgtggagttttggagcagtatattgttttacctgttgtgaactgacgtagcagtttatcatgcttgaacctgccattggttaaggttctttaagcttctgtttcttgccaggcagacctcggcaggatctcactaaaggcaggagaaaaaaagctgtgtgtatattgcagagttatagttttggtccatagtttcataacagtagacattcctacatgaaattattttagatggaatgtatatattccataattctataatcaaaatttcttagaataaatttttttccatctaaaacttgcagtatgaaaccaaagcttttcaataatcttttgttttctttttaaacattttttatttttaattatgggtaaataatagttgtacatatttatggggtatgtgtgatatttttatacaagcatacaatgtgtgatgatcaaatcagggtaattgggctatccattaactcaggcatttatcatttatttatgttaggaacattccaattccacttttttagttattttgaaatatgtgatagattattgttaactatagttgccctgttgtgccaccaaacactagatcctgttccttccatctaactgtatttttgtacccat

SEQ ID NO: 94038 - DNA, 638 bp, Homo sapiens
agctagtttaaaaaactcataggaagatcaatgaaactcccttgcagaggttgtaggagaacctgcttctgtaaattacagcactacacagtttccttagcattatagaaggattttcccaggacaggattttaaaatgataaacgctggcttattttagagggttactgttgtctcttgcgaaatctttttactatctggccatctaggcattgagggccaggattattaaccatctttaactgtatgcatacagatgctactcacctgtgcccatttgagaagaactttacaattctcttttgattttgttgttcagggtttacactgaagctactgttttctctatctacagcatcttaacatttatgatatgtctcaacccatctgaagcccagaacttttgttctttgtcttttctggataatgcctgcctgtctcttgagtatccctgtgacccacattcccaaagcagatatcatgtacatcacatagattatattttaagacagaccagtctgcacagatctttctgattttatggaaatacatccaaccatttttacatgatgtgatggcaaacttggaagaaacttaattttatttgtccgtgtgagactttttatgattttccccat

SEQ ID NO: 94039 - DNA, 475 bp, Homo sapiens
gagaattcgccactaccaagctaccacaacaagaactgctaaaagggctgtaaatcttggaacaaatcctggaaacacatcaaaacagaacctctttaaagcataaatctcacaggacctataaaacaaaaatacgatttaaaaagcaagaacaaaaaaccaaggtacacaggcaacaaatagcatgatgaatggaatggtacatcacatctcaatactaacattgactgtaaatggcctaagtgctccacttaaaagatacagaactgcagaatggataagaactcaccaaccaactatctgctgccttcaggagactcacctaacacataaggactcacataaacttcaagtaaaggagtggaaaaagtcatttcatgcaaatggataccaaaagcaagcagaggtagctattcttacatcagacaaaaaaatctttaaagcaatagcagttaaaaaagacaaagagggacat

SEQ ID NO: 94040 - DNA, 253 bp, Homo sapiens
cctcttctttttttttaagacaacctttttaaacataaagactatcacccagcactgtccaataggaatccctaggatgatgaaagtgttctgtatctgtgctgtccaacacagtagccactaactattgaacatttcaaacgtggctgtcgtaaggaaattaaaatttcaattgtatttttctttctttttttttttttgagacggagtcttgctctgtcgcccaggttggagtgcagtggcgcgatctctg

SEQ ID NO: 94041 - DNA, 204 bp, Homo sapiens
aaagtactgatcataacttgtagatgaacatacctggaaaggaagaaactagcacaattccctcccagtattctagaaggcggtgatgagaatctcccagagtggcaacagtgagaagggaaagaaaagagtgactgagtgacattgacaggagggacaagagggcagtggaattaaagcagccagggttgaagcttgtgatgc

SEQ ID NO: 94042 - DNA, 691 bp, Homo sapiens
agcggaaaaaaacttaaagacaataatgagagagaaaaaaagctggctagtgatttctcctgtagtggatgctgtggttttccacctagtctctctccataaccttctcagggctgaagctctcatttctccagtattgtgggtgttggcagctgcctgctcttagctttctcaggtgttgcctaaagccaaagacaatcacccttctgaggtcatacttccttcctgtgtcccatgactggcctgtgtagaacactgtgaagggcccacctgattccagagctccctacggaatgaagtgaggccttggccttgactgccattcagcttatccttttaccccaggatttctcaaattcagcactattgacattttgacctggatgattctttgttgtggtggccactctgtatattacagggtatttagcagtgtccttggcctctatccactagatgccagtatgtctccagatgttgctaaatatatcctggggttccaaaccttcccagttgagaaccatgatgcaatcctgccattttgacagtaccccctgaggcgctgatcctaagagcattccccaataaacttcctgcatacaaatcaccagatctgtagcgcacgcaacaaattcagttcactcaataaacacatgtttatttattagtaaagtatacctgtactactgta

SEQ ID NO: 94043 - DNA, 380 bp, Homo sapiens
caagactgaatggaaatctaagaagctactgcttgaaatgtcattcttttgcgataaagatgtggttggctaagaaaacatggccagatgtggctggtcacatgccatgaaggagaatgtaatcatgaaactgtggaaggatgtaacagggaaataggattctctagcacatacctttggctgctgatgttgtaatgtgtcaataatcccaggtcactcagttgtaattccagagaagtcacatttccctaccatggcactatcaagcagaaacttaacagtctgccccctattatctcctgcatttgtcttaggactctttgaaggcaggctttgtgctttcaatccccagtactcagcatctcacctgtccttggtac

SEQ ID NO: 94044 - DNA, 366 bp, Homo sapiens
tccagttccatctttctcatatccagtttgtacttcacacatcagacagaatccccatttacatttcctgagagcccccagcccacattatactacagcatgttcattcgaaccacaaagatttttggagcagcaacaggatctactttaggttctgggtatacaaagacaaataaaacattgtcttacactcaagtaatatggctaagtgagggagaaatgtctaactagttaaaagacaacaggcattttgggagaaagcatggctgtgctttgtgaagtcagcctcaaattgcagatcccttgttatttatctaccattcaccaattttcctgaaccaattggtcacaagcacaagtatttag

SEQ ID NO: 94045 - DNA, 237 bp, Homo sapiens
atttctaatcaagacttaggaaaatttgggatatttccatagggtaagtaagaaggtattttatgcagaatggaaaaatgactattttattactttgaaaagtacagtaggagtattagaactgaaatagtgctgaggaaaacacaactttctattttagaaaatcatttttaaagcctttttcacattaagtaaaaacccagaggaatataatccagatattttcatcgtagctta

SEQ ID NO: 94046 - DNA, 1412 bp, Homo sapiens
agcggggatctaaatgcccctctagccctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaaggttcagatccatccctcactgagtggcctggatgtcctcctggggttttggtctcccaccctgcaacggggacgactgtgcacatagcttcaggtcctgcccaacagccactgtcaccagtgctgcaaggatgagctcctgccatcagcccttatcccccagggcattcacgccagctctgttcttctctcagcactctctcctgatcgtaaacataattgattatggaaaatatggagaacacaaagatgcacaagggagaaaatgaaaagcatttatctggaatcctaccatctcacaaaaaagctatcatgaacattttgttccttccagtttcttaagtttgtgtgtctgtatttttttaataaacttgactggatggtaaaaaaaatgtattattttaaacctaaggcggtcga

SEQ ID NO: 94047 - DNA, 2955 bp, Homo sapiens
  misc_feature (2763)..(2764): n is a, c, g, or t
  misc_feature (2903)..(2903): n is a, c, g, or t
agcggggatctaaatgcccctctagccctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaagtaccaccagcttcaggacgagtatttcaccagcgccgttgtcctcaccctcatcctggctgccttatttggccttgtctaccttctaatattcccacagagtgtggtcgtcctgctcctgctagtattctgcatctgcttcctggtggcctgtgtcctgtacctgcacatcacccgggtccagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacagccctgcccaccctgccctgcgagtctacacaccatgccctgctctgctgcctggtgggcaccctcccgctagccatatttttccgggtgtcctccttgccaaaaatgatcctgctctccgggctcaccacgtcctacatcctcgttctggagctcagcggatacaccaggactgggggtggtgccgtctccgggcgcagctacgagccgattgtggccatcctgctcttctcctgtgcgctggccctgcatgccaggcaggtggacatcaggctgaggctggactacctctgggccgcacaggcagaggaggagcgagaggacatggagaaggtgaagctggacaacaggcgcatcctcttcaacctcctgccggcccacgtcgcccagcacttcctcatgtccaaccctcggaacatggacctctactaccagtcctactcccaggtgggcgtcatgtttgcctccatccccaacttcaatgacttctacatcgagctggacggcaacaacatgggggtggagtgtctgcggcttctcaacgagatcatcgccgactttgacgagctcatggaaaaagacttttacaaggacatagagaagatcaagaccatcgggagcacctacatggccgctgtggggctagcgcccacctcggggaccaaggctaagaagtccatctcctcccacctgagcacgctggcggactttgccattgagatgtttgacgttctggatgaaatcaactaccagtcttacaacgactttgtcctccgagttggcatcaatgttggccctgtggtggctggagtgattggcgctcgcaggccccagtacgacatctggggaaacacagtcaacgtggccagtcggatggatagcacaggggtccagggcagaatccaggtgactgaggaagtccaccggctgctgagaaggtgcccctaccactttgtgtgccgaggcaaagtcagtgtcaagggcaaaggcgagatgttgacatactttctagaaggcaggactgatggaaacggctcccaaatcaggtccctgggcttggatcggaaaatgtgtccatttgggagagctggccttcagggcagacgtccccccgtgtgccccatgcctggcgtctcagtcagggctgggctccctccacactccccaggccagtacctgccctctgcagcagctgggaaggaggcttagtggagcccacgtggnnctctggggtgcacatggggtgggaatgctccgggggtgacacaggccacggtggctccagccaggaccagccagaccagcagagcagggagccacttgccagggtggaggaggagcattgtccaggcatggcctgtgcncgagggccaaccaccgagcaggcacagcacagcagtgactcggtgaggggag

SEQ ID NO: 94048 - DNA, 1875 bp, Homo sapiens
agcggggatctaaatgcccctctagccctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaagtaccaccagcttcaggacgagtatttcaccagcgccgttgtcctcaccctcatcctggctgccttatttggccttgtctaccttctaatattcccacagagtgtggtcgtcctgctcctgctagtattctgcatctgcttcctggtggcctgtgtcctgtacctgcacatcacccgggtccagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacagccctgcccaccctgccctgcgagtctacacaccatgccctgctctgctgcctggtgggcaccctcccgctagccatatttttccgggtgtcctccttgccaaaaatgatcctgctctccgggctcaccacgtcctacatcctcgttctggagctcagcggatacaccaggactgggggtggtgccgtctccgggcgcagctacgagccgattgtggccatcctgctcttctcctgtgcgctggccctgcatgccaggcaggtggacatcaggctgaggctggactacctctgggccgcacaggcaagacgagccctttctgctttctgggggtgg

SEQ ID NO: 94049 - DNA, 1621 bp, Homo sapiens
cgtggaagtggcaggggtgggagagtttttcacttgctccagggtatccagcaccacatcaggggcatgctttgctgtgctctgtctctccagttctcggagttcattcaaagctgtgttcatcgtttcttcaatatcctgagcaattgtctctgggtccagtggcttgtggtcattgaagcccgtgtattgccctgatgacgtggaccttctaatgggagggctgtcgatcttcttgagggagtcgtgccggctgatgttggtcaggctgccatggccaggcctgcgcctccgctcaggactgtcattgttgaggccacggttctgcagcaggccccgggggtgactggcaaggcttggggaccctaggtcaactgaggagttagaaagggcatgtggagggtggagcgggcaatggccatcactggtcctgccaggacgccttactggagggggtggctctcctctttttcgttgcctggctaaatagccgtcaggatgacggtctgtcggggagttcatgtccttggatgaggacttgtcttccgtgactggcccactgctggcctcactgtcggctttttggctcagagtgtctgaaaacgtatcatccatatcctgcaccactatatactggtgaggcaccagcccgtcaatcccgttgtgcctgccttcccaccagtcctcagatgcacggtgatacagcagcagggaggcacccttcttgaaggatagttctctggcggaccgcccaacatagtcaaacttggctattgcttctattggctcacattcatcttcacttgtgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtg

SEQ ID NO: 94050 - DNA, 4915 bp, Homo sapiens
  misc_feature (4415)..(4415): n is a, c, g, or t
ggctgtcagaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcnagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 94051 - DNA, 4860 bp, Homo sapiens
  misc_feature (4360)..(4360): n is a, c, g, or t
tgagacactgtgctgacgggctcattgagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggtcagtgccaatacctgtctccctaactcttgcctctgaccctctggcctctgtctcagccccaacttctgactctgtctgaccctccagacccctgcatcagcctgaccatgacttgctctatgggctcctgggaaatgatctcctgaccttgatcccactgtgacctctacccacaggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcnagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 94052 - DNA, 4951 bp, Homo sapiens
  misc_feature (4451)..(4451): n is a, c, g, or t
ccagaggcaccaaggagcgcagaggcaccaaggagcgcagaggcaccaaggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggtcagtgccaatacctgtctccctaactcttgcctctgaccctctggcctctgtctcagccccaacttctgactctgtctgaccctccagacccctgcatcagcctgaccatgacttgctctatgggctcctgggaaatgatctcctgaccttgatcccactgtgacctctacccacaggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcnagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 94053 - DNA, 987 bp, Homo sapiens
  misc_feature (487)..(487): n is a, c, g, or t
ggctgtcagaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcnagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 94054 - DNA, 1925 bp, Homo sapiens
tgagacactgtgctgacgggctcattgagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggtcagtgccaatacctgtctccctaactcttgcctctgaccctctggcctctgtctcagccccaacttctgactctgtctgaccctccagacccctgcatcagcctgaccatgacttgctctatgggctcctgggaaatgatctcctgaccttgatcccactgtgacctctacccacaggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaaggtgggggcctatggggatgttaatgcacacgggaggttgtgtataagactgagacagtggccgggtgcgagggctcaggcctgtaatctcagaactttgggaggccgaggcaggtggatcacccgagatcaggagttcaagaccagcctgaccaacattgtgaaactccatctctattaaaaatacaaaaatcagcc

SEQ ID NO: 94055 - DNA, 295 bp, Homo sapiens
aaagtggggaacgagcagatggatgtaaagggattagtgtaatgattaggtacagagcaagtgctcaatataagtaagttcccaagtgcctccaacctaactgcccgacccctaggaccctggctcctcctgctcccacccttccccatcctcctgcccttggcattcttacctgctaccccctcccacagaaactctcggtgcctgatggcttcaaggtgtccaactcctcagcccggggctgggtcatccacccactgggcttgcgttccgagtttcccatctggatgatgtt

SEQ ID NO: 94056 - DNA, 328 bp, Homo sapiens
cccggggctgggtcatccacccactgggcttgcgttccgagtttcccatctggatgatgtttgcctccgccctgcctgctctgctggtcttcatcctcatattcctggagtctcagatcaccacgtgagagacagggtgggggctgggcctgggagggtgggaggcagggacctttccctggcattctcccaggcaggcaagagacccaggactgcaagctagtccctgcgggtgtgtggccctcccgactagcaggaatagtgaaaagccaggggcagttccaggttttgtgggaccagaagttgtataatttggagagctcttttt

SEQ ID NO: 94057 - DNA, 4961 bp, Homo sapiens
  misc_feature (4461)..(4461): n is a, c, g, or t
ggctgtcagaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattgcgtattttctaagagttttcaacatagtttggcttcacacacaacttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcnagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 94058 - DNA, 5224 bp, Homo sapiens
  misc_feature (4724)..(4724): n is a, c, g, or t
ggctgtcagaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcagtgcaggtgggtgttccctggcatcagcagtgctcccacctggaggctctggggacctggtcctagactcctatcttcgttgggggtggaagagcccctcacagcccagcctcagcggccacttcccacaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggtcagtgccaatacctgtctccctaactcttgcctctgaccctctggcctctgtctcagccccaacttctgactctgtctgaccctccagacccctgcatcagcctgaccatgacttgctctatgggctcctgggaaatgatctcctgaccttgatcccactgtgacctctacccacaggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcnagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 94059 - DNA, 3593 bp, Homo sapiens
  misc_feature (3540)..(3540): n is a, c, g, or t
  misc_feature (3569)..(3569): n is a, c, g, or t
tgagacactgtgctgacgggctcattgagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggtcagtgccaatacctgtctccctaactcttgcctctgaccctctggcctctgtctcagccccaacttctgactctgtctgaccctccagacccctgcatcagcctgaccatgacttgctctatgggctcctgggaaatgatctcctgaccttgatcccactgtgacctctacccacaggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaagtgctgggattacagacgtgaaccaccgcacccagctgattttttttttttttatgagtaggggaaatgtgaaatgagtcctttattttctctacttttggaagtttttcccaggggtgggggaagaatggtgttggggatcgcggttnagagatgcccagcaacttctctagaggtncgggtgaggcgtgtgcacttcctt

SEQ ID NO: 94060 - DNA, 2030 bp, Homo sapiens
gtcacaaaaagtgcagcgctacatgatctgtcaatttgaagtgcatctacggacattgcggagctatgaaagttaacaagatactctttcgcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgtt

SEQ ID NO: 94061 - DNA, 453 bp, Homo sapiens
tctgtgcactttgccttcttcctattcattttgatgtgtgtggtttttataggatctcaaagctatgctgttcatcttttatactgctaggcttcacacagcattcccctagccttttcaccacctctgattattgctagtgacatctgacaaaacaatctaactgtcatcattctattggccggtttacagaggcttccggaacctgctctgttggtagcagccatttaactgatgtctttttgtatgattgttcatcacttaataaaggatgaattcaggtatcttttcaaggagtgggtaatccctgtccttttaaggtgttggtataagatggcattactttttctaattaaggatttcaaaaattagcttttgtttttggagatgggataggggtgtgcatattctatgtgtaacataattaaatgccaggtagcggggtttcctcta

SEQ ID NO: 94062 - DNA, 280 bp, Homo sapiens
atacccatataatagaatggtatttggcaagaaaaggagtggagtactggtgcatgttacaatatggatgaacctcaaaaatgtaatgctgagtgaaagaagccagtcacaaaaaaaacccacattatatgattccatctatatgaaatgtccagaataggcaaatttaaagagacagagagtaggttagtggctgcctagggatgggggtggggagagggttgattgggaggagaaagaagggggcagggactgcttcagtttctgtcgacgcggccgc

SEQ ID NO: 94063 - DNA, 3561 bp, Homo sapiens
agcgggaggggctgctggcggctgggctgccggggccgacgcctgggtggctgctgccgccgcgcctgctgcgagatggcgatcttgggcgcggaagggtgagtggcgcccgccgcaggaggaggtgccgctgccgtggccgcccggctgccgggagccgacagcttcgcgccggggttgtctcctcacagactatgagctccttgaaagagggaatcgtgtcttactcatctttgtatccccagtgtctagcagttcctgatacatagttttagctgaattttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgtt

SEQ ID NO: 94064 - DNA, 2829 bp, Homo sapiens
tctgtgcactttgccttcttcctattcattttgatgtgtgtggtttttataggatctcaaagctatgctgttcatcttttatactgctaggcttcacacagcattcccctagccttttcaccacctctgattattgctagtgacatctgacaaaacaatctaactgtcatcattctattggccggtttacagaggcttccggaacctgctctgttggtagcagccatttaactgatgtctttttgtatgattgttcatcacttaataaaggatgaattcagttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgtt

SEQ ID NO: 94065 - DNA, 1796 bp, Homo sapiens
agcgggaggggctgctggcggctgggctgccggggccgacgcctgggtggctgctgccgccgcgcctgctgcgagatggcgatcttgggcgcggaagggtgagtggcgcccgccgcaggaggaggtgccgctgccgtggccgcccggctgccgggagccgacagcttcgcgccggggttgtctcctcacagactatgagctccttgaaagagggaatcgtgtcttactcatctttgtatccccagtgtctagcagttcctgatacatagttttagctgaattttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagctgatgggagcaagatgcgcgcagtcttctcccatcagtacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttcttttcttttacattccctttcctctaggtaataaaggcctgacatatctgatgggtgcaagactt

SEQ ID NO: 94066 - DNA, 369 bp, Homo sapiens
agggttgattgggaggagaaagaagggggtgactgcttaatggtatggagtttatttttatggtaacaaaactgttttaaaattgattgtggtgatggttgtgccactctgaatatagtgaaaccattgaattgtacagtttaagtgggtgaattatatgatatgtgaatgatagctcactaaaactgttacagaaacattcaaatggctctcaagcattatcagtagcccttttgtattgtttcttcattctgccaacgagaagagttctagttgcacaagaagcacaattccattcttattgattgattagtgtgcagtactactttttggcaacacatactcactagtgaattatttgtctgttag

SEQ ID NO: 94067 - DNA, 3761 bp, Homo sapiens
agcgggaggggctgctggcggctgggctgccggggccgacgcctgggtggctgctgccgccgcgcctgctgcgagatggcgatcttgggcgcggaagggtgagtggcgcccgccgcaggaggaggtgccgctgccgtggccgcccggctgccgggagccgacagcttcgcgccggggttgtctcctcacagactatgagctccttgaaagagggaatcgtgtcttactcatctttgtatccccagtgtctagcagttcctgatacatagttttagctgaattttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagttaggagccatcgcactttaaaagcagatggttgcatagacggaggacgtggggactgggtcggaacaggaatatatacaggaagtagtcgtcgatggagaaattacgaacaacagcgaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgtt

SEQ ID NO: 94068 - DNA, 2234 bp, Homo sapiens
acgccgcaccgcggttcaaaacagtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgtt

SEQ ID NO: 94069 - DNA, 414 bp, Homo sapiens
ttccgtgactcgtgggtaggcagcgtctcacgtggccatgcatgtcagtgacccacacagcctccacactgtgaggttagcatgtctcgtgggcagacagcagtgtccttggatgtacccgggggctttgtgctgtagagatgttattttaaataataagccaagtcgaggatgggagcgtttccatggcaacttgaattttaaaaccaagatttctttggttactgtggtggctgagaacactggcagctgccatgtccagtggctctcaactcctggaggacaacctgccgtggccattccctggagtcccacagggccccctcgccacttcactagcaggcgacttccctgcacccgccctccttttcatggttcccaggccctcccacacctccctgtgctccctactca

SEQ ID NO: 94070 - DNA, 382 bp, Homo sapiens
gcctcctgggtataagagccccttgtcttacctttgcaggcccatgcctgatacaatttggatgtttgtccctcctcatctcatgttgaaatgtgatccccagtgttggaggtgaggcctagtgggaggtgttgggtaacaggggtgaatggcttggtgctatcctcgtgacagtgagtgagttcttcttgcaagatccttaaaagtatatgccacctccccctctctctaactcctgatctcctgtaacatgcctgctcccccttcaccttctgtcatgaatgtaagcttcctgaggcctcaccagcagtagatgccagcaccatgtttcttgtactatctgcagaatcatgagccaattaaatctctttactttataaat

SEQ ID NO: 94071 - DNA, 165 bp, Homo sapiens
gcagataaagtctccctggtgataaaagttgttggagcagctctcttccgggtgcagacacctcactaaagcggctctcctttacagatgcaaattgcttttacaaaaggacagcttttcagagcgactcctggctccgcagtttctcagaataaccggcagtga

SEQ ID NO: 94072 - DNA, 357 bp, Homo sapiens
tatttctttgacagggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcat

SEQ ID NO: 94073 - DNA, 167 bp, Homo sapiens
aatcctctccgtctcagaagcctaaagggggagtgagttggttttgggaggatgaactggaggagacgctgtgggtggagaaaaagcaggtggaaagagggtatgtgtttgagtgcctactgtgtgcaggaccaggtgagaaggtgctgatctggatgcacaggctg

SEQ ID NO: 94074 - DNA, 1930 bp, Homo sapiens
ctttcacttctttgacttcatcttctccattctttcatggtgccttctggattgctcctagtacacttaggcatactcctgcctcagggcctttacatttgctatgctttctgcctgggaagttgtctgctcagatatccctaacctccctcaagtcgttcctcaaatgttacctcctccagaagctttccttgatcatcacccctctccgaacatagcacccctcatactttctatgtaccctctctgcttaatttttatccacagcatttctttctttctttcaaaacagggtctcactctgtcacccaggctggaatgcagtgggctcaagtgatcctcccacctcagcctcctggatagctaggactacaggtgcacgccaccatgcctggctaatttttaaactttttgtagatagggggtcttactatgttgcccaggttgggtctccaacttctggcctcaagtgatcctcctcctttggcctcccaaactgcgggattacaggcatgagacagcactcctagcctctccatagcatttctaatcatacagcagtccatatattgtccttatacatttaccatctgtctttcccacgtggaagaggtaagctccacgagggctggaattgttgtttgtgctctctgctgtgtcctcaacccctagaagcgtgcctagcatgcaaaaggcactcagtatatatttgttgagtaaatgaatgcttcccccaccttccaactgttagagcaggccaaggggacctgttgtgcagaacttcacagctttctactctgagctctatcttccttgttcttccccagcttttacttaggagccacttcttgactgagcttgtcacaggtgaaaggctgatgaatctggagagatacttgtggcaagtacccggtgttcctgcagtcatccacaagcgcagcagtggtggtagacagctagagaagaaagtgtaaagtttgcatcctccaattatcacggttgcaagacagaacttgaaactagatacacctgattttggttatctctggatgccattcaccgagaatgaagggaagaagatacttcctccaaaggagaatctgatgaggcgccagcaggctgctgctgcggtggaaactgccacatccgcttttgcaaactggtgtggccccagctgcttggactgaggctcaacgcaggtttcagccacttcaaccacagggctacgaacatgccaagagagccactaaccaagtttctcattcctcctctgagatttaaagtccatcacttcgcgactcaaacacgcaagaggcgtgggagacggaggaatggggaagcgaggcggcgctgcccaccttggcaatggcacagccgcggtctctgatgcaaaggcaggcggccgcgcagggccgggcctgggtgggaaggctgggctctgggaaggatgtcggggcacccggcagtgcccaaagccaccatctcaagcgtgatagtggggaaatggatgctgcacctgctctctcatcttgcggggaatcgtgatttggggaagtttcacctttgttgcagaactgcccacattagagccttcatttcttgggaaggggttggcgggagttgccagtgaaatgtgtgacacacacacgcgccacatactccccaaacccacagacgactccagtaacgctctagttacccttaaaaagtaaaacagaacaaatcagcaggccccctccctccatcctggcacttcattaatgtcggccaaggccacatttcccctgcccactgcagggagtctgtcaggagaacaacaggcgaacgtttgcctcacttgactcagctctcttggggcggtatcagcattttaaaattcacacctaaaggaaggagtcagcaaaggaaagcagagctgggccggggcgcc

SEQ ID NO: 94075 - DNA, 1719 bp, Homo sapiens
ctttcacttctttgacttcatcttctccattctttcatggtgccttctggattgctcctagtacacttaggcatactcctgcctcagggcctttacatttgctatgctttctgcctgggaagttgtctgctcagatatccctaacctccctcaagtcgttcctcaaatgttacctcctccagaagctttccttgatcatcacccctctccgaacatagcacccctcatactttctatgtaccctctctgcttaatttttatccacagcatttctttctttctttcaaaacagggtctcactctgtcacccaggctggaatgcagtgggctcaagtgatcctcccacctcagcctcctggatagctaggactacaggtgcacgccaccatgcctggctaatttttaaactttttgtagatagggggtcttactatgttgcccaggttgggtctccaacttctggcctcaagtgatcctcctcctttggcctcccaaactgcgggattacaggcatgagacagcactcctagcctctccatagcatttctaatcatacagcagtccatatattgtccttatacatttaccatctgtctttcccacgtggaagaggtaagctccacgagggctggaattgttgtttgtgctctctgctgtgtcctcaacccctagaagcgtgcctagcatgcaaaaggcactcagtatatatttgttgagtaaatgaatgcttcccccaccttccaactgttagagcaggccaaggggacctgttgtgcagaacttcacagctttctactctgagctctatcttccttgttcttccccagcttttacttaggagccacttcttgactgagcttgtcacaggtgaaaggctgatgaatctggagagatacttgtggcaagtacccggtgttcctgcagtcatccacaagcggcttttgcaaactggtgtggccccagctgcttggactgaggctcaacgcaggtttcagccacttcaaccacagggctacgaacatgccaagagagccactaaccaagtttctcattcctcctctgagatttaaagtccatcacttcgcgactcaaacacgcaagaggcgtgggagacggaggaatggggaagcgaggcggcgctgcccaccttggcaatggcacagccgcggtctctgatgcaaaggcaggcggccgcgcagggccgggcctgggtgggaaggctgggctctgggaaggatgtcggggcacccggcagtgcccaaagccaccatctcaagcgtgatagtggggaaatggatgctgcacctgctctctcatcttgcggggaatcgtgatttggggaagtttcacctttgttgcagaactgcccacattagagccttcatttcttgggaaggggttggcgggagttgccagtgaaatgtgtgacacacacacgcgccacatactccccaaacccacagacgactccagtaacgctctagttacccttaaaaagtaaaacagaacaaatcagcaggccccctccctccatcctggcacttcattaatgtcggccaaggccacatttcccctgcccactgcagggagtctgtcaggagaacaacaggcgaacgtttgcctcacttgactcagctctcttggggcggtatcagcattttaaaattcacacctaaaggaaggagtcagcaaaggaaagcagagctgggccggggcgcc

SEQ ID NO: 94076 - DNA, 582 bp, Homo sapiens
gtggaatgtcatcaattaaggcaggaaccggccatctggatgtgtatgtgcaggtcacaggggatatgatggcttagcttgggctcagaggcctgacagctatgtcctagatcttggaatgttttcacgttgattttattgcacaaactgatagtctttcccgattacatctctgataatgcattttaaatcatttaataacattttacacctttagacattttaaaacaaagggtttagacatttttaaactgttaccattaactctgattgatacaattgagagtcagaagaaagtaagccatatatcaagcaatacaatcattatcattgaatcaaaaacaacccaattgcaacaggtgtattagctctacaattgttctcgaaataataaataatttactgtgttattttcaaatatatcgatggcctaaatgtggaaaaatgtaattcccagaaaacagaaaaacaactcagcaaagatcccatttcaactaccaaggcttatcccccatgcttacatgattattttgcgtattaaggagattttcactaagcttacttgatagttaaagttctcca

SEQ ID NO: 94077 - DNA, 501 bp, Homo sapiens
aggcctgtttctccacctgagccctggccctggcaggctggctcacagctctgacttgaggaggcaggtgaaggcgtcaccctgtgagtctgcggacgtccgggaaccggggcccctcctgcacacagctggccttcccgccttccaggggccagcctccctgtgtgcctaatggctggtagtctcgggagtgcaaagtccagccacccccagatggtgggctctgtggttggtgcccaccgtggggtcaccccagcacccacttatctaatcggccccatcgctccgcccggccccgccctgtggctcccataggccagctgggtccagctttgttgggagcggccctgtctcagggatcatgctgtttgcttttgataaaagtcacaaaaaaggaaagaaaaaggagtgagggggagggaaggaaaaaccccaggctgacggggttctggaagcctctgtgggtcagcggactggcggtgaggctggtgcacagaccac

SEQ ID NO: 94078 - DNA, 348 bp, Homo sapiens
ggtgaggttaagtgttgtgagcatatgctcagaaatgccatgtgactctaatcatctccacttgagcagtttctctgtctagtaaattgcatattgcagtaaaaagggatctctccgagttctcatgtattttttaaattgtgtttactggaatactgcaaaccttgaataacactgtgggacccatacaaaatgctacttgtgatcctggaagtacttctaagaacagagaaaagtcatgatattataagaaaaaagttgaatgcagctgggtgcacaggctgaggcaagaggattgcttaagcccaggagttctaggtactagtgtgctgtgattgtgcctgcaaa

SEQ ID NO: 94079 - DNA, 280 bp, Homo sapiens
cctgttatccaatttgatgagctcaaagtctgttgggtgagacagatgtaaaaagatatcataatataaaaataagaatgaaatactgacttgcaggggcccaaggggtagttgtaagagaagggaagatcagaggtatgggggcgtctttgaggatgtcacacatctgatgtcaggcaagtacttgaggaaatgtgacaagtttattgtaaatgaatcacaggggcccacagggtacctagtggagcagatggaaaggggttggagctctaatcctgga

SEQ ID NO: 94080 - DNA, 756 bp, Homo sapiens
tttaatgaacgacttgaattaaaatagaaatgcagttttatttcagtgtattttctgatgtggaaatattgtaagttttctaacctgacgtctcatgctcttttctacaaggcactgctgcttaaaataataagaatgtgtttttaaaaataaagtttttatttatatgcagggttaccttcaaacttggctcttaatttaactataaaggagtatgagtattttatctttaatttttttaatgaaataaggcctgtatggaccatttgttaagactctaagatttcagatttttttcatattaatcaatctagagagactttgctattgaatagtgggcttatattacataagtacttatgaagattgctcataacaccaaaatagtgaaataaagtgttcacaagagaaaggaaaacattatcatagtttaataagttttatttgtgcttttattttcattcacattttatatattctctctcatggcaatttaattttagcttgtttatcagtgagatgtacccatgtgatttttttttcccccctcaattctgatactagacacatacaatttttttgtttgttttaatgctctctgagatgttctcaagacacacgtgattttaaagtcagtgcctatgtggctctttttcctccagtatattattttccattcttttttttttggctgtgttgcccaggctggtctcaaactcccaggctaaagtgatcctctcacctcagcctcctgag

SEQ ID NO: 94081 - DNA, 281 bp, Homo sapiens
gagatggagtctcactctgtcacccaggttggagtgcagtggtgcaatcttggctcactgaaacctccacaatcttctcagctcagcctccggagtacctggtaccacaggcgtgtgccaccacacccagcttatttttggcagagatggggttttgccatgttgcccaggctggtcttgaactcctgagctcagaaaatccacctgcctcagcctcccagcatatagggatttacaggcattagccaccatgcacagccagatttttctactacatattt

SEQ ID NO: 94082 - DNA, 670 bp, Homo sapiens
tgttattaagtccattgttaggagtggttcctaatctcccaggctgcaggctttgtttgctccatacacctggccttctctgtagcagctgaagtttgatgctggagctgggtcagggtggagagactgtgtggagccaggactcatgaccctggcctgtttctcccgctctctaggcctaaatcccagcagtcacactggccatctctaatggttccttccacagcactgttcttcagagcccacacacaaattttgtctccttttgtgatgactgcacttctttggctgtttttgccaacagcctcttcactgaccccttccttccactgcattgacccagacatctggatgtggatgaggtcgagtcacttgttgcctttggctaatgcataggggcacgagtagagctctagaatcaccatgcccttgactcagggtgcagaatctgcctatggtgcttgagctgtggttgtcgctagaggagaattaccatggctcccccgggcagatgaagatgacgaggtggtgcctcagccccgaggagtgaactgcagggcaccgacaagattctgcctgtggccatcagggctggagggaaggaggccaggttcatctacccaagctggtggcatgaggcataaatttaaaaaaattggtgtgggcacag

SEQ ID NO: 94083 - DNA, 86 bp, Homo sapiens
ttattcacctgctattttatcaatgtcatttataaattaaaatttttcttattataactataccttaaaaacaccaataaaattgc

SEQ ID NO: 94084 - DNA, 469 bp, Homo sapiens
tctcaaaatcctgcctcagccttccaagtagctgggactacaggtgtgcaccactacgcctggctaaattttgtatttttagtagagacggggtttcggcacgttggccaagctgatctcaatctgctgacctcaaatgatctacccgctttggcctcccaaaatgctggtattacaagtgtgagccactgtgccctcttttgtaattttattggcctgtgaaaatcagagatccaggaaccgctgtttaaaacactctggcttattcatcttattatttatagatttctcacgatagatcagtttatttcttagtttgatttgaacatatttcacagaatgattaataatgaaatactgggtgccaacggcctacttttatttggctttttatgtgttgcttcttgttaccttatacccaaccatgtgggattgagtttattgtgctaataggcaggtattacctata

SEQ ID NO: 94085 - DNA, 439 bp, Homo sapiens
ggcgccccgggtatccctttatgccacgctcacagctcgcagcccggggggcactccaggttccgtttctcgggggatctcacactggggagctgctgtaggtaaatcgccgctggaagcagtttaattccagttgcgggtgtcttaaaaatcccattggctgctttagtatctgtcttattcccccttctttctctgctccccccaaccccccactatctcttaaatgtttccaaccagcactattcaggtggtaaaattactgcctgcatattcctggaggaacttgtgttatgtttaatatttacggggatgaacatctgctggaacaagcatattaactgcactctgttctgcctctggtaatcgcttattgtagagctgagcttttttttttttccttttgctttaattcagtaaagagttcacatgtgtctaa

SEQ ID NO: 94086 - DNA, 463 bp, Homo sapiens
atacatgttcttacgttagggttctccagggaaatagaatcgttgggaaatagataaaatatgaaggagatttattatgaggaaattggtttatgctattttgaagactgagaagtcccgtggagtgctgtctgtaagccaagcctcgggaaagctggaagtggaattcattctgcaggtctagaaccaggggacccagtggtgtcagttccagtccaagggcaggagaagactgatgttccagctcaggcaggccagcaggaagaaaaaggggtaaattcctccctcctctaccttttgttctattcaagcccttgacagaatggattatggccacccacattggtgatggcatcttctttgttcagtctgctgattcagatgcacagacacacccacgaacagtgtttaatctaggcactctgtggcacagttaagttgacacacaaaattaatcatcaca

SEQ ID NO: 94087 - DNA, 427 bp, Homo sapiens
ggaagacactgggttacctgaatcttgaagagtctggttaatgtcttgactcctaacatgtgacattattttcaattggtcccacttggcagttagggagaaatttctcctttacatcaagaggaaggtcaaaggaaagggtaatctcaagtgtaagagctaaggctttaataagcaaatagttaagacttaagatccccaaagaaaaagaacattttatattaaggactcagtaagtgggagttttacttctcattcccaaggagctccctatttctcactctggctctgaaaagagccctgcaaagcaacatggtcactgacgcctattgtgagaaaatgtgtgaatggagtcttaccactcctcttcactaaggtctttagtaaaatttcaaagtcaattttaccaacagtaaaagttaccctg

SEQ ID NO: 94088 - DNA, 419 bp, Homo sapiens
ctgaggaggctctggggacagggtgaagggcagtccaggaacagaaagcccgcagctcagagaccagccaggggctgctgagaaggtctagggaggaggtgacctggatggatgggggaggcctggggcaagcatcctggggcgggcagaagcaatcaggtgccccaggtctaatgccggcaggtgggacacatgttggcagcttccatggaagaagcctctactgaaaaccacatcgggttctggggaagcactggggaggccatcgtctgagctttagggacaaccttgctatgcacggacagtggtagtcagtccgctgtaggaatctaggggttagatgacagtctacagatctggacccattgcagacaagatcacggagtcccggcaggaagcagctatctgggaacaggtgt

SEQ ID NO: 94089 - DNA, 1293 bp, Homo sapiens
atttaacacataattattctatttgatcacttaatcttacatgtatagcattaaacatatatgggatattttcttttttttgtaatatgttttcgtaatgtacgtgacagatcttataagtataatgtacattatttcctactacaaaaatttaattttccatgaaattattgatagaaatttataacaagcctaaaaatcatctagattatcaagattgttttatttttaatggttattgaatgatttatttttatcaatttttaaacattatgtaccagaaatatgtctgaggttcactttctaattgatattgaaatttgtaacatgttcaatgagaatattatgtgtaagagtacaattgagatattgcttgacaactttatgtagactgagtagagaagaaaacatttgaaaggaattatgttagaaattatgtcttttggcatgtttttctaggtttggcaaaaaaaattacttatttttaacacttctttttccgtgttgatcatacattttttgttcttttattcattttcaaagaaaaccgggaaatgagcaagacaagtgggcgactcaacaatggcatacctcagattccagtgaaacagaggagaatccgaatttgattcttttaggcagtctttaccagtgtttgagaaacaggaagaaattgttaacaataattaaggaaaataaagtagttttgattgtaggagaaactgggtctggaaagaccacacagattcctcagttccttttagatgattgctttaaaaatggtatcccctgccgtatattttgtactcaaccaagacgattggcagctatcgctgtggctgaaagagttgccgcagagagacgggaaaggattggtcaaacaattggttatcagatccgattagaaagcagggtttctccaaagacacttctgacattttgtactaatggggtattgcttcgtacattgatggcaggagatagtacgttgtcgactgtgacacatgttatcgtggatgaagtgcatgaaagggatcgatttagtgattttttacttacaaagttaagagatttgttgcaaaagcacccaactttgaaactaattctttctagtgctgccttggatgtaaatctctttataagatattttggaagttgtccagtgatatatatacagggaagaccatttgaagtaaaagaaatgtttctggaagatattttaagaacaactggatatacaaacaaagaaatgttaaaatataaaaaggaaaaacagcaaggtaaattttttaa

SEQ ID NO: 94090 - DNA, 1395 bp, Homo sapiens
ggcttcacttctgctgtggcggtgactgaggcctttctggtgacctcagcccaacacaggccgtctccggagcttcccggtagtggccccggattcccacggtctttgtcattggctgtcagctagcaggcctggccgctcccgtgcggagagaccatctcttcagggcaatgtccaggccgagcagcgtctccccgcggcagccggctcctggcggtggcggaggcggcggcccctcgccttgtggccctgggggcggcggccgggccaaggggctgaaggacattcgcattgatgaggaggtgaagatcgcagtcaatatcgcgctggagcgcttccgatacggggaccagagagaaatggaatttccttcttctttgaccagtactgaaagagcctttattcatcgactcagtcagtctcttggtttggtctctaaaagtaaaggaaagggagcaaatagatacctaactgtgaagaagaaagatggatcagaaacagctcatgcaatgatgacctgtaatttgactcataatacaaaacatgctgttaggagcctaattcaaagatttcctgtcaccaataaagagcgtacagaacttctgcctaaaacagaaagaggaaatgtgtttgcagttgaagctgaaaaccgggaaatgagcaagacaagtgggcgactcaacaatggcatacctcagattccagtgaaacagaggagaatccgaatttgattcttttaggcagtctttaccagtgtttgagaaacaggaagaaattgttaacaataattaaggaaaataaagtagttttgattgtaggagaaactgggtctggaaagaccacacagattcctcagttccttttagatgattgctttaaaaatggtatcccctgccgtatattttgtactcaaccaagacgattggcagctatcgctgtggctgaaagagttgccgcagagagacgggaaaggattggtcaaacaattggttatcagatccgattagaaagcagggtttctccaaagacacttctgacattttgtactaatggggtattgcttcgtacattgatggcaggagatagtacgttgtcgactgtgacacatgttatcgtggatgaagtgcatgaaagggatcgatttagtgattttttacttacaaagttaagagatttgttgcaaaagcacccaactttgaaactaattctttctagtgctgccttggatgtaaatctctttataagatattttggaagttgtccagtgatatatatacagggaagaccatttgaagtaaaagaaatgtttctggaagatattttaagaacaactggatatacaaacaaagaaatgttaaaatataaaaaggaaaaacagcaaggtaaattttttaa

SEQ ID NO: 94091 - DNA, 320 bp, Homo sapiens
caagcatgtgaatgtcaggagcagagagaaagggaagggaagaagaagggaggagagagaagagggatggtgtttgggggcattgggatggctctcttccttcttggtctaaatcacagagcctgatcaggagagggtcagagttccagactcttgaagagtcaggaagaacatcagaagtgaagctactgccatctgaggtggccctgggttggctattcacagagggctggaatgggatgatggggctgtactccccactaaggctgccagatctggaacttgaccttgaagtctagttatccaggactcttaaggct

SEQ ID NO: 94092 - DNA, 129 bp, Homo sapiens
catccttccctcactcaccctgtaccagctgcaagggcaccttgcaagctttcaaacacccaagcacgttgttgcctcagggactttgcatgactttttctctgtcccaacagtctttatttttattta

SEQ ID NO: 94093 - DNA, 551 bp, Homo sapiens
ctttcgctgttctcgcgaagtgatctatctgaaataaaaatctaatcatgggagtctgtcttaaatgttcactgcctccctattgccaacagaaagtagctttacctctcaaatgttttctatgcacaagtcactctttaaaaatattatattgtataatccaaacagcaactaaatgaggtacttacctttattatcaccattttataaatgaggaaacaaatacagagaaaataaatacctggcccaaggtcacatagctgataataacagggccaggattcggcccaagcagtctgatgatagatgccctgtgtgtaaacactatgcaatgatacttctaatttcttagcttcccacaaaggcagggtttgaatttcaaagtgaaccaagagaggatgggcccattttatatcatcctataccaatgaatgtggcctgccttgccacactgtgtaaaggagattgtttcacattttatggtataaacttaatgctgaaaggcagtagttcttatcgcctgagttggtacaagtactaatggttcttaa

SEQ ID NO: 94094 - DNA, 614 bp, Homo sapiens
  misc_feature (2)..(2): n is a, c, g, or t
  misc_feature (10)..(10): n is a, c, g, or t
  misc_feature (12)..(13): n is a, c, g, or t
  misc_feature (16)..(16): n is a, c, g, or t
  misc_feature (21)..(21): n is a, c, g, or t
  misc_feature (27)..(27): n is a, c, g, or t
  misc_feature (594)..(594): n is a, c, g, or t
gngaggcagnannatngcttnaacccnggggtcgggggcggaggcggaggttgcagtgggccgagatcacgccattttctgggcgagagagcgagactccgtctcaaaaaaaaaaaaaaaaaccatgaaagaaataagctcagtgaaggcgggcattctgcctggctaacgcaggtcgctccttgccgtgcctggaacattactgtaagtgctcagcaaactactttaaggtaggaataaaatctgcaaggttgcttttgtttaaattggataaccttttgtgttccaagtctttggagtaattttgtgttccaagtctttggaataattgtgtccttaattattatactagtcactgttaaattttgaaactccagtgcgtcccatgaaggtaatgatacaaaacatttccagctgggattgttccagggaatccagactaatcaattatctgggctcattatatctatggatctttatttttcacctctttccttatgtttttcttaatccttctagctgatagtgatcactccctttaaaactgtcattcttaaaatcagaacaacatagtttatcatttacttattattntcttcatgtgattgttctcc

SEQ ID NO: 94095 - DNA, 646 bp, Homo sapiens
ctttaaacttatttggcacttctcataggaccttaatagcatttatgtaaacctaacgtttaaaggactcatgaggagtttcctttggcctgcagtgtcttgtttttacctttttttttttaggttggtgaaatgccagggtgcaggggatagccagttggattagagcataagtactgctccaattatttggcagagtgtctagtaaaagtcctctacaatatcaccatacatttgcttggggatggctaagcgtggactgatgggcaagctcttggaaaggcttgagctccttgcatccttttatgcttctaaggaacaccaaattttactcttgccgtgagaggcacaaagtaaacttggcattcagaggtggaagcaggcttgccctcgggggcggacccccggggtattgagtttcaggaaataacagatagagagctcagcatgatggattatcctaaactgtgggattttgcaagagagccaccatatgtccatttctggtcaatgaggagaccgtccgagtggaaaggggataatctggacctctgggctaccatgcgtacaagcgtgataataatttttatttaaagtgcgaagggaatatttaattcattccagccaggcatttgcatcttgatat

SEQ ID NO: 94096 - DNA, 907 bp, Homo sapiens
ccaaggcatccacctgcaccctgaagcctggcatcgtgtactaccacggtggcgggggcgtcatggggagtttgaaaacccaccatggcatatgctctcgtttgtgcaaggagagtgactccgtggttctggcagttggttaccgcaagttacctaagcataagtttccagtgccagtaagagactgcttggtggccaccatccacttcctgaagtccctggatgcatatggagtggatccagcccgggttgtggtctgcggtgacagtttcggaggggcaatagccgcagtggtttgtcaacaacttgtggacaggccagatctgccccggatccgggctcagatcctgatctatgccattctccaagccctggatttacaaaccccttcgtttcaacagaggaaaaacatcccactgctcacctggagtttcatctgctactgtttttttcaaaacctggatttcagctcctcctggcaagaggtcatcatgaaaggtgcccatttgcctgctgaagtctgggaaaagtacagaaagtggttgggcccagaaaacatccctgagaggtttaaggagaggggttaccaactgaagccccatgagcccatgaatgaagctgcttacttggaagtaagtgttgtcctggatgtgatgtgctcgcccctgattgcagaagatgacatagtgtctcagctcccggaaacctgcatcgtgagctgtgagtatgatgctctccgggacaattcactgttgtacaagaaaaggctggaagacctgggagtgcccgtgacctggcaccatatggaggatggtttccatggagtgctcaggaccattgacatgagcttcttgcactttccctgctccatgagaattctgagtgcattagttcaatttgtaaaggg

SEQ ID NO: 94097 - DNA, 442 bp, Homo sapiens
ccccgttttaagacccttaaacttaatcacatctgcaaagtcctttcggccatgtaagttaacatattcacaggctccaggaattaagacatggatatctttgggggccattattctacccgccattgaaggataacaaaatgcatggctgatttaatctacattaaattcacacatctgatatttttgctgaaaatcataaattaaactagtgattgccaatagagactatgaaactttgacctaattcattggatgtaatcatccccaaggatattaaaatgcctcaaaataattaatgtgggaaattcagattagaaagaaatgtttcaccaactcaaatgttcaaaactcttaggtacagatgggagtctcgtaaagtgacactattcttagtttaatatttttattgagaggctcacatcagatgaagttaattaaa

SEQ ID NO: 94098 - DNA, 559 bp, Homo sapiens
caccttaattgggggagcttggttagtaaatagaattgctatgttaaatgcttcttgtaagatctcttccttgaaattcctgaatttctctctatttatattatattgttgaattcattctgtaatgctttgttatactgataaaattaatgccccattcagagaagtagtatttcctaaagatatatagtcactgagcggctcaaaaccaatcactaccaataattttttaatgtggttggggagattaaaaaataagtgttttttgcattttcctaacaaattatttggagcctatgctcacagaaacctgttaaatatcttaataggaatttgaaaaggatggcagatatgaacagccaattttgcaagctaagctcttcaatactcaccctcactcctacccaggtctagctttcattaatattttcttctgttttgcacgaatgatctgcccaggatcttggtattttaattcaactgcatagaaatcaacccaaaacagccttgctcttgatgcagtggccaagtcccgcctgtcatgcctgaagcctatggg

SEQ ID NO: 94099 - DNA, 328 bp, Homo sapiens
ccaaattaccactgggaacaaaggctttaagctagttcatgaactcatttctgtattaacctattgggtttcttttttacttgacttcagggctgctgagagatcactgtaatcctcaaaccacttggtatgatgatagtgtccctttctttaaatggcttctattctctccttcgattttaaatttcttaacctttaactgtgctgtttcatatgtgttatcctaatcagacatttcaaattacccacagaagttagaaagaaataatcaaaaaagaaagaactgaggagacgacgtttatttcattttaagaagagaagccaagca

SEQ ID NO: 94100 - DNA, 465 bp, Homo sapiens
gtcccttctctgcatctgagatcagccggggagttgttcagcaggcctgataatctgcactctggaacccacagactggtctgttgctgtaggacaggttgtacttttgaaacttttttgagcaaggttagccctggaccaagcatgccatctctaagagccctcagacaccagaactgggaagacagccctttgcctctcaggaagctgtgcagctcctctccaggtgagacaaagtagtttgaggaccctcaacctgggcattccaagttcttctccaggcaggacctggatcctccatgcccagccacgctgcctggatgtgggtattcccaggaatgggttatcctccccaagggccaccctaccactctcctatgttcatggaagaaaccccagaccaatgtcaacaacaatgttatttctcagtaattatcagttatacttctctaacaaatggatgaa

SEQ ID NO: 94101 - DNA, 377 bp, Homo sapiens
cagccccgcactcccttccctatctggctccatgtgtatgcaatcacctgggaccccccaatgcttcaccctcgggcctggggctgtgatgctgctgacttcatgttttgacaaaagtctggagttaaaaaggccatgctaacctgcagagcctttggagaacagctggaattaagccagctcccggccaaggtgcctgctctgtcaagaggccgtcccaagtgcctcctgcctgtggcacggggctgaccactccgccatgatctctgccaggagcagtgggccagcccagccatgctcagttctactcaagacaaccccaggggagccactgtgtcgatgcacggccaacagggagctcaaccctgcttctcaag

SEQ ID NO: 94102 - DNA, 340 bp, Homo sapiens
atcatccacaaaatttaagagaatgctgtctacatagtcacacaataaatgttagttgaacaaaccaacagattcacaagaagaataaaacagcaacaaggcctaaaatctgagagagacaccattcaaagcctcctagctcaatggttctcaaccctagatgcatattggaatcacctggaagcctctacacagccccacttcctaggtctgccctaatcagactctctggcactggtaccattttaaagttcttcaagtgatgctgatgcaaaaccagggatgagaaccattgctccagaccagtgctgtcccacagacccttttgcaatgatggaag

SEQ ID NO: 94103 - DNA, 450 bp, Homo sapiens
ggtaatctggattttggttatagctccattggtagctatatagaaaccagggaaaaataaacaatctggttttatgtctcctcacctgcaaaatgaagatgctggacttgattggtccaaagctatcggatacctagtagtttaactttagatcccaaactttgaggcacatagccatctgcttagactaaggggagagaactagaatgaatctactctttttcaaatcctcggagacatgtaagatctcaaggtccgtgtttcagatgaaaccattcaagaaataggccaaaaaaaagcctgtgttcattaatcatctaatgatgaattagagtgagggagtgttgaagatattaaggacagtcaacaggcaaatgaagaatagtccccttggcaaaatttggcagactcatctaagaacggaagttcctttaaaagagaaataaatgt

SEQ ID NO: 94104 - DNA, 2679 bp, Homo sapiens
  misc_feature (1169)..(1170): n is a, c, g, or t
  misc_feature (1213)..(1213): n is a, c, g, or t
  misc_feature (1503)..(1503): n is a, c, g, or t
ctttgacccagcactgctggacccatctagtccgttcctcacactcgcggactggaagctccaggctgcacaaccaccaactgcaccaaccatgtgcctaaagctaactgtgtcaaaaagagcatgcttcgaggggctggagtgagcaattcaacttgtggagaaataagaaataatagtgttgagacaagaaacataaaaccgcagggtaagaacttttggagaaagatttcttgggaggaagctatcctgaacgcttagagacttttctcatttactggcacaccagctttagagtcctaggtcttcatcctggctcagccaccctccagctgtgtgaactttgagaagttgcttgactacactgagtctcgttgtcactatgagtggaggttgctacgttgctactgtgtggagcacctacccccaagcactcttataagctgcagcatatcatgagtgatgagatctgtgtacaggtgactgacctttacctggcagaaaataataatggggccaccggaggccagccgaacacacagaactcaagaagcctcctggagtcaacgtatccacagaaagccaagcagctaatgtcagatgagaaatgctttaaggtgagagttgctcatgtagtcaaagaccttgctggtgacaatgtaagttgttaggattctctgaatcggaagttatagccagggtactttgaccccgtgattctactcctggaactttttagagttcctaatgagttcaccagagaaatacaaagtggaagtaaccatcttcctggacaatctattttgtttctttcttgccttaaaaaaaaaaaactagttatatatgatttttacaattttgtattcttctttttccctgaacatttttcataatatgctttgtatctcttattgttaaaaaaaaaagttggtacatgaaacccatggtcgtggtcattatagaaaaaaaagtaggcctggcacacttggctcacacttgtaatcccagcactctggcaggccgagatgggtagatcgcttgagaccagcttgggcaatgcagcaaaaccccatctttgcaaaaaatacaagaatacaaaaattagccaggtgtggtgcatgcgcctctagtcccagctactcaggagacagaggtgggagaattgcttnngcctgggaggtcaaggttgcagtgagccctgatcatatcactntgttccagcctgggtgacagagtaagaccctatctcaaaaaaacaaaacaaaacaaaaaatgcagataaccaaaaaaagtcaccttagaattctttcctgaaattaccattgatgacatttctagactttcctgtgcttgagtatatattttgaaagagtttatactggacaaatggtctttcactttatttatttatttatttatttagagacagggtcaggctctgttgcacaggctggagtgcagtggtatgatcctggctcactgcaaccgtgcctcctgggttcnagtgatcatcgtgcctcagccaccctagtagttggaattacatgggccaccacactggctaatttttgtatttttagcagagatgtgtgtcagatcccagggtccaggtccagcccatggtgaagtctgaggggagtgggtgggtgagcagaaagaacaatcggggggccataggcaggtgaaagatagttttattcagcggcagctctcattaacagctttcttacactagctctcttattagcagcttactcttccactgttcgcctgtctcagcagcttgagccagctgcccctacacatagctgcgcagccagctctctcttgccttcagggtcagcagcttaactccttctctctctgggcatgagcaagcccagctgtgtcctggctccctcccatctgcctgcaagatggacagctttggctctctctttctctgggtgccagtgtgctcatcatgtcaagccatgttaagccaaactgagccaagccccgaagagccatgtctcttatgcacggcatcaacagggcagttataccttttacagacaatagtggcataaagccaggaatgaacttacacaaacaggttatattacaagtggagctgtgtgcttgcacgccaaactcgtgagtcacacaggcctagatatccacctcggcctattccttgaccaaagcacatctatgtaccttactatgtggttttgtatgttggccaggctggtctcaaactcctgaactcaagtgatctgcccgcttcagcccccaagtgctgggattacaggtgtgagccactgcatctgaccggaaaggatgtatttttgctcaattagcaacacttctgggtctttaatgtcttttctatggctatttgatattcactttatagagaattaatgcctgtattgttggacatttaagttgtttccaagttttcaccattataactgtatttgtgtgtatatattatattcttgccaggctgtaagctttactagcagagaggaaattttaaagctttaaaagaacgctgagctagatctagcttctggctctgtgtgtttattgaccagtggtgtgccttgagaaaccagaactctctgaatttcagttttgtctctgtgtaaatgaagaaggttgtaataaaaaaaatctcaagtttccttccag

SEQ ID NO: 94105 - DNA, 630 bp, Homo sapiens
gcatcagtaactcaggctgtttcccacactacaggccagcactgtgggctctcagtttattgggaaatggaaataagagggaaggacaaaagtccactgggaagcagactggacagaaaggaactctgagcagctaaactctgactaatcccagggtatacctgcgttttctcttcaccagacaaactgcggcctggaccagctggtgaaacataattctgaatcctgcccacagccttcggtggttttggatgaaaggccagcgccttgggagccctgcgtttgatttcaagttttaaggccggcactggtggagcaatgaatggtgaaagctctccccttaaaggagcacagttgcctttaggtgactgctaactcaggcttttgctgaggacagtgtttactttgtgagcttaatgacagggctggctttctgggagtgttgcaatgaaacagactcagacacaggccatcatgggcctcctccctagcaaggccgccacggctggcatctcaagagcagtccgttgaacttgggatttgggtgtgagacacagtttcatcagaagaatttaaaccaaagtctacatttgccctctagataaatgtgtgtgttcagcagcaaccaca

SEQ ID NO: 94106 - DNA, 703 bp, Homo sapiens
gcatcagtaactcaggctgtttcccacactacaggccagcactgtgggctctcagtttattgggaaatggaaataagagggaaggacaaaagtccactgggaagcagactggacagaaaggaactctgagcagctaaactctgactaatcccagggtatacctgcgttttctcttcaccagacaaactgcggcctggaccagctggtgaaacataattctgaatcctgcccacagccttcggtggttttggatgaaaggccagcgccttgggagccctgcgtttgatttcaagttttaaggccggcactggtggagcaatgaatggtgaaagctctccccttaaaggagcacagttgcctttaggtgactgctaactcaggcttttgctgaggacagtgtttactttgtgagcttaatgacagggctggctttctgggagtgttgcaatgaaacagactcagacacaggccatcatgggcctcctccctagcaaggccgccacggctggcatctcaagagcagtccgttgaacttgggatttgggtgtgagacacagtttcatcagaagaatttaaaccaaagtctacatttgccctctagataaatgtgtgtgttcagcagcaaccacaactccttgcctcattctcttggttgattatgtgactgtgagaagaaaagcaaaagcaaaaatgcgaagcgtag

SEQ ID NO: 94107 - DNA, 775 bp, Homo sapiens
gcatcagtaactcaggctgtttcccacactacaggccagcactgtgggctctcagtttattgggaaatggaaataagagggaaggacaaaagtccactgggaagcagactggacagaaaggaactctgagcagctaaactctgactaatcccagggtatacctgcgttttctcttcaccagatttttcctaccaggaagagcatgtgctgaccaacagacatgaatttcagcctggtagttacaacattcacagtatacccacatcactaagctgggaggcacattttgagacccagaatcctgacacctccatgcattcaaaaggacaaactgcggcctggaccagctggtgaaacataattctgaatcctgcccacagccttcggtggttttggatgaaaggccagcgccttgggagccctgcgtttgatttcaagttttaaggccggcactggtggagcaatgaatggtgaaagctctccccttaaaggagcacagttgcctttaggtgactgctaactcaggcttttgctgaggacagtgtttactttgtgagcttaatgacagggctggctttctgggagtgttgcaatgaaacagactcagacacaggccatcatgggcctcctccctagcaaggccgccacggctggcatctcaagagcagtccgttgaacttgggatttgggtgtgagacacagtttcatcagaagaatttaaaccaaagtctacatttgccctctagataaatgtgtgtgttcagcagcaaccaca

SEQ ID NO: 94108 - DNA, 463 bp, Homo sapiens
cttgacctttatacttggaagattctccattgagtagcacagatttaggaacatagaatgcatctcctgctttagggattccatcatagtatttgattctccagtgaaaaatatttacataatcatcattttataattgttattcatatttaaaattttatattctatctgtacagagaaagcataaaaattataactaggaagggaacgtaaatgttattaatataagtttttacagtataaagatagttacatacctgactagctttatgtttgtgggggaaagacaagtgcaggggagtatagggctgttaactgtgttaacttacatagaatatgttgtaaaataccatgtgaagttgacatggtaaggaaaactacaattaaaaggactgacagtatgaaaagttggcccagatttaaagcaattggaactttcatatactgctcatagaagtataat

SEQ ID NO: 94109 - DNA, 391 bp, Homo sapiens
aataaaagctaatatttattgagcatctactatgtgctaagcatttttctaagagctttatatgatgaactcataacaatgttatttacttattctaactttgcctatgaagtatccattttaggactggaatattatttgttgtatttacagataaaaataaaagctcagagataaaaacaacttgtctacgagcacattttagtgttcttttcccagcattaatcacaatggctccatgtattctttccttctaagtgcacaaatgagttctttcagtatcaattcctcaaagtcaggactatgcagattgaacccagtcagcaactccagatatgtgaattaccatgtatctgcaataatatgcctaggtcatacttttcatgaagca

SEQ ID NO: 94110 - DNA, 414 bp, Homo sapiens
tgcagagttcatggtccttggtttgaaaatgagatatacttttattttctctatgatttgtctttcatggttggcctgaattacagaatttagaaccttaaaaattaaaataaccatccagaagtagaactgacccaatcacgagagctctcattttgcccaagtttcctgttggttctcaagatgatcaaaggaagctatagagagtagcacttcaagaggcttcttccatgatacttcagaaagggaaggggagcagaatcatgtgataataacgcggctttaaaaaggctattgtaaaggtagcaccagaacctcacttctgcatccctcttgcctcttctatctgtcatgaccctttttaagggagttcccatgtgacagttccatacaggatcagcccaaggcactgga

SEQ ID NO: 94111 - DNA, 171 bp, Homo sapiens
ttgagatcatccctctggagcctggcatgggcatctcccctctgggctagaacatagcttaacagattgtccgtgtgcctcaacccctcaaaaactgccacttccagttcctaacattcttgttttgttttgagacgaagtcttgctctgtcacccaggctggagtgcagt

SEQ ID NO: 94112 - DNA, 355 bp, Homo sapiens
ttcagcatgtaagatcctccatcccttccttgaaaataatacggcaaaaaatccagtgtataattatggtctcggccatttgcacagcaagccattcagagttgtaaacttaataaaaggtagggtgtgtcccaagaccagatcatattctcaggactatgatgtattccacctgattaggggaacagaccacattatatggtaaagagcttggactctgtcatcacaccaactttgattcaaatctagactctgctaccaattagctctgtgatgtttaggcaaataaattcacttctttgggcttcatttttctttttctttttctttttttatttttatgagacagagtttc

SEQ ID NO: 94113 - DNA, 473 bp, Homo sapiens
gtagaaaagctgagaagatcagaggctaccattcctgccatgtgccagagtaatggctctggcatccaaaaaccaatcagtgtaataagccatatcaacagaataatggatcaaaacacacgttcatctcaatagatgcagaatacatatataaaacaaaatccaacctccttttataataaaaacacttactgaactagggagagaagggaacgtcttcaaactgacaaaagacacctatataaaacctgcagttaacattacatttaatggtcaatgactgatggcttttctctatgatcaggaggaagacaagaatgtcagcttttgccatttttatttaacagtgtactacaggttctatccagtgcaattagggaagaaaaataaatggaaagcatccaaattggaaaggaagtagtaaagctatatctattaaagatgacatgatcttgtatataagaaattcatca

SEQ ID NO: 94114 - DNA, 248 bp, Homo sapiens
ctgagcagaggacattatctgacttaagttctaaaagattatctctggcttagctatattgagactaggttgtaggggcccaaaggcagaagccgggagaacatttaagaggcagttacaaataatcgaattagaaaatatgtggttacctgaaccaaggtagttggggtggtagtgagaagtggtaatagtttggatatattttaaaggctagagctgatggatttcctggtatagtgtagagaaag

SEQ ID NO: 94115 - DNA, 472 bp, Homo sapiens
gttcagaggagagatcagattggtttgtcaggtcactgttttttattcattgtagaccactgtagacgggcggagactttctgccaagcctgtcttcagtctgcagattggctgctctttgcactctccagtcggcctgggcttcaaaagtgggcctaagtggttgaatgtagggcagccctctgtgtttaaaaaagtcaaaaagcttaaaaaggtgcatgtggcagaaattttcaaaaaacaaaaggagcattataagcaacaggccccttccattgtctgacttgtaaaatgtgcaacgcaataggcagctattctttgtgtacagatgtacctcaaatcccagaccatcagggccctcagttagctagcgtcagtggaggggtacgactcagacacaattaaccacaacatatggaagcatggaagatggcacttggcagaaactaagccttaggagtggagcctgtca

SEQ ID NO: 94116 - DNA, 647 bp, Homo sapiens
actcacgtgtttagatttctgtctagtgatttttgtggagtttttcacatccatttactctaaactgtaagaatataaggaaagagttttctaaaaatagggtgacaagcaacttttaatataaaactgagagtgacgctgaactaataatatttagtgtacatgtgaaaatgatgtgtaccattcttagaatatccagtttagaaataagatttttaattcctggagatagagctaatttaaagaatcagctcaaatttgtcctgattgtatttaaaataaaaatcacttattttgctttactcttatgtttaacatcttttccaaattctgaagcaaattgagtggtagacacaactgtttacattttcattgaacaagtggcaacgaaatctctgaaacttagacaatgattatacgtccacgttccaatatgtaatacaaaaagcaaatataaatttcacataacctagaatattatgcctagtacaacattatcctttcctgtatgcataagcagacacatcccaaccccaccagtcccaacaaatggtacctaaagtctgtaaaagcagataaaagctctaaaaatgaatctgctttccgagattattgagtgaaaagactgctacattttttattcccta

SEQ ID NO: 94117 - DNA, 183 bp, Homo sapiens
ttaaaccttcaagtgggcagcttgcctgtggctgcctccaggaagtcttgaagactcccagcctgggtcaagagcctctccttggtcatgcacagtggctcatacctgtaatcccagtgctttgggaggccaaggtgggcagatcacctgaggtcaggagttcaagaccagcctggccaatat

SEQ ID NO: 94118 - DNA, 259 bp, Homo sapiens
ccagtttgtcaccagtcgccactcccacccccaacctcaggcagccatgcgtctgctttctgtctatagttctgccttttctagaaacttcatataaacacatagtctttggtttctggcttccacttggcataatgtttttggggttaattcatgtttttccatgaactagtcttttttttttttttttttttttgagataagttttgcctttttaacaaagcttgttttccggaatccggggccaaaaccacagcca

SEQ ID NO: 94119 - DNA, 628 bp, Homo sapiens
gagctgaatggtggacgggtctggtgatatggtggacgggtctgagctgcacatggtagcgtgtgcctgtagtcccagctacttgtgggggctgagttgggaggatcgcttgaacctgggaggttgaggctgcaatgagccgagatcgtgccattgcactccagactggttgacaaagtgagatcctgtgtcaaatagtaacagtaataatcaaaatataaatggagtttgtcactatcagtttctcaaaggcaaaagaaaatgaaaaatattcctggttgataagagtgagagaaaaatgatcgttataccttatggggtataaaatgttatctttccagaaagcaacttgacaatgtttacctaaagccttaagactgtgccttttgactgggtgtggtggctcacacctgtaatcaaaacattttgggaggccaaggcaggaggatcacttacttgagcccaggagttcaagatcagccttggcaacatagtgagaccccgcatctacaaataataatttttaaaaaattagcagcatgtagtggcatgcacctgtggtcccagatactcaggaggctgaggcaggagggtcgcctgagcccaagaggttgaggctgcagtgagc

SEQ ID NO: 94120 - DNA, 401 bp, Homo sapiens
ttctagttttaaaacaattgcttcaagttagccagactgactcaggggactccatgcagactttgcatgtgttttgcttcatagccattcagagtacagggagatgatgatcacaagacagggaggactgtgttgttctttagggagtgatgttgtttgactcttcgcagacggaggacatcagcagtgtctcgaggccttcttttcatgtctttcgttcagccactcctgcagcctccagtccacctcctcacagcacgcgtgcgtgtccctgggtacttgcagatagatggagtaaagattaaggaacacaatggcaagttaatgaactgttttaagaccaaaatgacttactacagctttatgaaatgtgtaggtagtagactgccttaaagttctat

SEQ ID NO: 94121 - DNA, 188 bp, Homo sapiens
accaaaaacaaaggtgaaactaggataaaatttctcacctgtgtgattggtaaatgtgcaggtttgacatcatgctttgtttatgaagctgtgggatacaaggactctcatacgtcactgtggaatgcagaacattgcaacctcatggaagaggatttggcagcatctaacaaaagtatgtggcattt

SEQ ID NO: 94122 - DNA, 637 bp, Homo sapiens
ctccggaatcgtcagttgccctggctcagcgaccacccttcaggctccccaactcccgttggtcccgaactcccctcccccgcaccccatcctttcggatcccagttgctccaggaaaacatgcttgatcctgtcacaaacacatatagcacacatggaaccaccataggccctgctgacatggttttttgtgttttggacaatctcataagacttcgggtcttatagcacgaaccccttgaagtctgcgtgggtacacaccacagtagattttggtgctttcccagccttcttggtataaagttacagcaagaagacgtgaaaggttgggaaaggagacctctgattccaaggactcgttcaaaagatgctgagaccgaggcttaagcttcagggcacctcggccccacctgctggccggagacggtagcgctgccccagccgctcagtgcttatggggctggcagagggatgggatggggctggctgggaagaagaggtcgctgaggccccgcctgggagctgcagagctggggcaaacctggggctctgggcaggtctgccccaggcagtatactgtggagaatgaaacttttctaaatgatcaataaaaaagccaaagtggagtcagctgtgc

SEQ ID NO: 94123 - DNA, 352 bp, Homo sapiens
gctgcctggaggcccaaggagccacctgcctgaacttgctaccaccagtgcccacatacgccaccttgggatccaaggactgacaatttcagttcactgccaccaccactggtgtctgatgaccagtctgcctggcatccctgtctcccacagagccttgccgtaacctccactaacaactgcagcctaaaccactgaagaattcatagacacctctgatgctgattatagctaaagaaatcatacagaccctacactactgcacccacccagaatcaaagccaaggtatcctacccaaataacattatagatatatctatagaaaaagtctttccctatgaaagccaattc

SEQ ID NO: 94124 - DNA, 108 bp, Homo sapiens
ctggcaaaacttggtgtcagccctagaatccaggcctgctaagctggggttgggggagaagagggccaccttctgattttcacggtaaagaaagggatgcccagagga

SEQ ID NO: 94125 - DNA, 303 bp, Homo sapiens
cacctttttacaggacattttccagtaggggcttctctcaaacggatgagtggtaagtcaagtccttcctttccatatcacactcagcagacacctgatcctgatatgctagaggcacagggagactagatatgtacgtggtcttcccagagtgggagtggccacagtgaaggaagaacaatgatggaggggcctgatactggtaattccaactctatggaagtaacaagtccccagaaatacttcaggaggaggaaagcagtagggaggtgctatcaggaaatacctgagaacaaagcaaaa

SEQ ID NO: 94126 - DNA, 201 bp, Homo sapiens
ccatttaattttaacttcagcctcaagtaattacattcaccactctcagtttaccaatggggaaactaaggcccagagacttaagtgacttgggtgaggtcacacactggtcagtggcagagtggaacttgcaatcaagtctctgcctctgagtcttgctgtcatagggtcaagggggcagctctggaagggactgcaggt

SEQ ID NO: 94127 - DNA, 542 bp, Homo sapiens
agcggccgcctactactactaaattcgcggccgcgtcgacgcagtggtagggatcattcctcaatatgtgtgagagctgagcctaactgaatgatatgggaaacttgctcagcaatgcaaggaaagagaacgggtggctgcggctgccagtgcgtgctggtgaatgcagcccatgggcggttggtgggttggggaatgatggtaaccaaatttcaaggcctttaaaccatcaccgtgctgtggtcatcgggctttctcttcagcatccctcctaattatctggcctttcccacgtgcctgaggttcctgatctggtgtccacaatgatctgagaactgattcaaggattcttggagccctcagacccaggaagaagagagtttttaggttccaaatgaggagagtaaactttttgttgttcagtttgattatccttcacaacaaagagaaggtactagaaacttggatgagggagatgagacagtggaaaggattcaagcacacagatgagtcacttggattctaagagttaaaaaaaaaaa

SEQ ID NO: 94128 - DNA, 932 bp, Homo sapiens
ccgtgcccggctttctccttttctttagactaaaacccaagctccctcctatggctcatgagtttttcagctcatgacctctggccacctcccaacctctgtgctcccacctctgcctccattaccagattccagccacagattcttgttcctggaattaaagcgaaaacaaaatgaacaaacctgttcccgccatggggcgtttgcccttgtttgtgcctagattgctctttccctagatccttgctaggctccctgtctctttgttcaactctcagcacaaatatcagagtggccttctctctctcaccaatctctgttaatctctgtcccattcctctgctttatttacctcacaacttttaccactgtctgaaattctcctgtctctgcctttatgtattgtacatcctttcccattcatgtgcgagcagtggtagggatcattcctcaatatgtgtgagagctgagcctaactgaatgatatgggaaacttgctcagcaatgcaaggaaagagaacgggtggctgcggctgccagtgcgtgctggtgaatgcagcccatgggcggttggtgggttggggaatgatggtaaccaaatttcaaggcctttaaaccatcaccgtgctgtggtcatcgggctttctcttcagcatccctcctaattatctggcctttcccacgtgcctgaggttcctgatctggtgtccacaatgatctgagaactgattcaaggattcttggagccctcagacccaggaagaagagagtttttaggttccaaatgaggagagtaaactttttgttgttcagtttgattatccttcacaacaaagagaaggtactagaaacttggatgagggagatgagacagtggaaaggattcaagcacacagatgagtcacttggattctaagagttaaaaaaaaaaa

SEQ ID NO: 94129 - DNA, 878 bp, Homo sapiens
ccgtgcccggctttctccttttctttagactaaaacccaagctccctcctatggctcatgagtttttcagctcatgacctctggccacctcccaacctctgtgctcccacctctgcctccattaccagattccagccacagattcttgttcctggaattaaagcgaaaacttgctctttccctagatccttgctaggctccctgtctctttgttcaactctcagcacaaatatcagagtggccttctctctctcaccaatctctgttaatctctgtcccattcctctgctttatttacctcacaacttttaccactgtctgaaattctcctgtctctgcctttatgtattgtacatcctttcccattcatgtgcgagcagtggtagggatcattcctcaatatgtgtgagagctgagcctaactgaatgatatgggaaacttgctcagcaatgcaaggaaagagaacgggtggctgcggctgccagtgcgtgctggtgaatgcagcccatgggcggttggtgggttggggaatgatggtaaccaaatttcaaggcctttaaaccatcaccgtgctgtggtcatcgggctttctcttcagcatccctcctaattatctggcctttcccacgtgcctgaggttcctgatctggtgtccacaatgatctgagaactgattcaaggattcttggagccctcagacccaggaagaagagagtttttaggttccaaatgaggagagtaaactttttgttgttcagtttgattatccttcacaacaaagagaaggtactagaaacttggatgagggagatgagacagtggaaaggattcaagcacacagatgagtcacttggattctaagagttaaaaaaaaaaa

SEQ ID NO: 94130 - DNA, 265 bp, Homo sapiens
agagcagaagctaggattttattacttttaaattcctctatcaccaggcaaagaataaacacatgtacatactgatagaccaaatccatctcaagtggactttcacttagaaacctattgtgagtaagtggaataagctgatgacattaactccctacctactttctatctaagcacatacttacacaacagttactatgtttcaggcactatcctgaatacttcatagatattaactcattaaagcctcctaacaaccctatgt

SEQ ID NO: 94131 - DNA, 404 bp, Homo sapiens
aaagaagccagatgcaaaagaccaaatattgtttgatttcacttatataaaatgtcaaaaacaagcaaatccacagagaaacaaagcatatctgtgattgcctagggctgggggtgggcacagggattaactgcattcaagcaggatgggtaatcttagggtgatgaaaatgtctaaaactcaacgatgaagtcccagctacagcaatcagacaagagaaagaaataaagggcatccaaactggaaaagaagaagtcaaattatccttgtttgcagatgacatgatcttatatttggaaaaacctagactccatcaaaaaacgattagaactcataaacaaattcagtatagttgcaagatacaaaatcaacatacaaaaatcagtagtgtttctatatgccag

SEQ ID NO: 94132 - DNA, 986 bp, Homo sapiens
  misc_feature (978)..(978): n is a, c, g, or t
  misc_feature (980)..(982): n is a, c, g, or t
  misc_feature (985)..(985): n is a, c, g, or t
tcaagagtgaagagagaatgctaggatgcagtggggacagcaggcggcatcaagcaggggtccctgaaagatctacctcctctttacacctgcccctcttccccaccgttatcatctggcaaatgtctgttacctatctttggtttctccctccccatccttcctgcacaccccagccaaattgatttttaaagcatcattttgcacaagtcaccactctccttaaaaccaactttcaggagctttcctgcacgtaaaccctcgtttcagccaacctggtttacccactctgagcaagccgcatggagatcaggccgcccctgcccactccagcctgggcaaaagagctagactctgtctcaaaaaaaatatatataaaaaaaatttctaagtgatgaatgcttagggtattgctgcttatttcttactgtactgtggtgtcaacatttctaagtgtccataggacttctttgggcctgaatatattatcagtttttataaaagcatttgtgtaatctcaaaatgtgtttttattctaccagttctatttgttaactcaattttttcattattttattcaaatccatattttctctgactttcatttactttagagttcttaatctgggggtccatggcctgcctaggagtctttagcatgtaggggtttaggagttgcagacccctagggatcgaacaaagctgggtatgtgcttgaaggaattttgctgggacaaggatctgtagtatttactatatttttaaatgcctctgtgacaccaaagcagttcagaacactcatttacctgatctaatcatagtttgatgtttgtgtgttatatctctatgtattcctgtttcacttttaatttctgtatgtgtattgtcgctatgttgtgcagtttttctcaagtcatttttgagaaataggcagggtatgaattatcaataaataagtatcatgtttggggcatatanannnaana

SEQ ID NO: 94133 - DNA, 407 bp, Homo sapiens
gctacaggcagctgtgcgcctgtagtcccagctacttgggaggctgaggcaggagaatggtgtgaacccgggaggcagagcttgcagtgagccgaggtggtgccactgcactccagcctgggcaaaagagctagactctgtctcaaaaaaaatatatataaaaaaaatttctaagtgatgaatgcttagggtattgctgcttatttcttactgtactgtggtgtcaacatttctaagtgtccataggacttctttgggcctgaatatattatcagtttttataaaagcatttgtgtaatctcaaaatgtgtttttattctaccagttctatttgttaactcaattttttcattattttattcaaatccatattttctctgactttcatttactttagagttcttaat

SEQ ID NO: 94134 - DNA, 891 bp, Homo sapiens
attcgtaagggtaagaaccacatggactaaaacacatcaaataggtttaaaatccgtaagtgtacagtgatgcttaacacaaaacactgaaagtctctcactggccacctttgaagaatgttagaaaaccaactcattattttgaaaatcagtaaagaatcaagcatttatttttccctttcttgaacagctatatctgtgggtaaccaaacagttaatgaggggagattggtgtttatagaagtttccagctaataaacagaataccatgattttacaaccccctaatgaaataatggatctagcaatgattagtgatggcttctcattccaaacagacaaccagatattgtacctactgaggtacacataaagaaaaaacaaaatcaaatctgaacttgatgaagcctctacatctaactcattattgaaaagtttaacaagtctgggcacagtggctcatgcctggaatcccagcactttgggaggccgaggcgggtggatcgcttgaggccaggagttcgagaccagcctgggcaacacggtaaaaccccgtctctacaaaaatattacagaaattagccaggcatggtggtatgcgcctgtagtcccagctacttgggaggctgagatgggaggatcatttgaacccaggaggtggaggctgcagtgagctgtgctcgtgccactgcactccagcctgggcaacaaactgagaccctgtctttaaaggaaaaaaaaaaaaaggttggccgggcgcggtggctcatgcccataatcccagcactttgggaagccaaggcaggaggatcacctgaggtcagaagtttgtgaccagcctggacagcatggggaaaccccgtctctactaaaaatacaaaaattagccag

SEQ ID NO: 94135 - DNA, 244 bp, Homo sapiens
aacattcaccatagaaaatcctcaaaaaattaagcacatattttatctccttttaagatatctgtcaaggattgtcttcaccaagggcacatagtaggaaaggtgccattctaactcctggaacaatttaatcagtactaacatacttcaggtagcaggggtgtggaatcaggtcagtaacaaaaacggacttgcaggccagagtaaagatatattggctaatcttaactaacataatttactg

SEQ ID NO: 94136 - DNA, 473 bp, Homo sapiens
tgcttacatgcagcatgggaaggagctggcagagaaggagtgaagaaggcgaagacacaggaaacagaggtattcaggatggagtgaaggaggagggaaggagacaaaatgaccaggtggaggcacacctactcctctacaaatgcagatgaaagctgcaggtggggaagacagccagggagctcccaccagaaaaagacaagcatggcttcccccagccccacctgtcagtatatagggcatgagcctgtccctcctgaagcaaatatccccaagggactggttaggctctgactccaggccagctttaggctgtgcacaggtagagtaagatctcagaggctctttgaaagcctttttaactggtagacatctccctcacttgcttattaatgcctgaccaccataaagggcaccacgtggtaatttcaactgtggggcttatttcacacatcacgcatatagatcagaca

SEQ ID NO: 94137 - DNA, 386 bp, Homo sapiens
gatgttcatgcctcagccacccgagtagctgggattacaggcacccaccaccatgtccggctaatatttgtatttttagtagagacagggttttgccatgttggcaaggctggtctcagactcctggtctcatgtgatctgcccgcctcagcctcccaaatagaaatactatttggacatttttactgctatgttttctcttcaaagccatctatttgataggagagtgaagaaaaactattaaatcaataattccaaagtgttagaattttagagtttacagacatcatggaggtcacttagcgcaactctctacaaaggatgggtctgagcagtacatccttaataaatggctgtccaagtatgattgacctttccctgttcca

SEQ ID NO: 94138 - DNA, 846 bp, Homo sapiens
actggattattgatatttctatggaagaatgggctttgaactgccaaaataagaacttgagggtttctgtttccggtaatgaatgagtaaatttctgtcatacttaatcccctgcaataagcaactctaaaatatgcacgataaaaaccagctactccaaggaactctgtaggatgagtgtaagcagagtctgaaatagagttggtccttgaaggaaggaagttagtacactgaatactagttttcctggcttttagcctgaggcaaagcacattaggtggcactcattccaacccagagaaatctctgctgatggagaaagataaaaagaagggaaagaaaagagaacgggaatccccaaattgtagctgaccccaggattatatgtgcagagtagacataagcatctcatctaaagatgtgaactaagaccatagttggcacctgagaaacaaagtgtgcagccctcaattgaatcaagatattgcctactacaaaacaaaacgaaaacaaaaccagaaccagaaacaaaagaaaaaaattcgtcaaaataatctagaatcaggatacagtttaaaattaagctctgaaagtaaatcatactctcaaaagaaaatcagctgataccaaccattacattttggaactaagagacagattttttgtttttgtttttttaaatagctgttaactagtctcataaggacaaaatacagaaagacagttcttacagagaaatagaagcaaaaaaaggaaccaatggaaaatttaaaactgaaaaatagaatatctgaaataaaaaattcactagatgacataactgttgaggaaagagtatgtgaattt

SEQ ID NO: 94139 - DNA, 619 bp, Homo sapiens
agcggcctcagtttattctaaatgtcccagacctttggccttctaaaatcttcactaatatcaaggagcctgaatcttaatgggatttatggctcaccattgccatacaagctttctaaggtattcatagaacttgtcacttcctggtcaacatatcaacagcaggatgtcatccttatagtgtaccaccaagatttcctctgggatatcaacatgattaattcatattgattcacatttgaatgatattttgaatcgcatcatattgatttaaatttatattaattaatattaaattcagtctattgtagtggaatgttttgcctttttcatgtaaaaaccatgtttgattaatattactctcagcgatgagtactgagaagaaagccatatcagtagcataaagcaagcagcaaaggctctgtggatctgttgcagtaaagatggcacattcccagttgctgcagtagaggcctggccaacacggtgaaaccccatctctactaaaaatgcaaaagttatctggaaattgcttgaatctgggaggcagaggttgcagtgagctgagattgtggcactccaaccttggggaacagagcaagatttcatctcaaaaaaa

SEQ ID NO: 94140 - DNA, 450 bp, Homo sapiens
ttatcatacgttaaattaaaactgacatttccaaaacatatctaattagggttagcagctacattgaccatagtctatggctaaaagaagtcagtccacaaattcaataaattgttgtaaagaaatggaactgtctttaacgtatatcactctcccatacagatggaatttatactcatgcaaattggcttagtagaaagtatacaagctttaatgccaggtcatacatttcccgtcctcagctttatcactcccagtcaatgggaccttgagcaaagccatctcacctctgatcctctgggccttcttccatcaaaatgtgctcatcctgcccacgtcacctggcttttgtgaagaatttagcaagataacggtgaaatgccaagcacacacactctatgttcaagaaacatcagctcccattttgtgcaacattttccagagctgttt

SEQ ID NO: 94141 - DNA, 414 bp, Homo sapiens
agctacaagtggcttgttagatatcagagagtgtactgaattagaaaaaatgttctactgttggccagttgccaccaacagaaaagttaggaagatgtttaagttgatggagtgcttaatttagtgatagtttttggtgagcttttggaaagctttactaggatttaggaatatgcctgagtctcagtaagcttctccttagagaattgaagagtctctgcaattccacagaaggcagtacttccgaaaaccatcaaaaggatattattctgtaatgctcgtaagttctgtctttagccagttaaatatgatatctactggattttaaatgactgccattttaaagaatgtcttttaagagtttactgatttaagtcttttgataggcctgtcttatggctgtcatcctgattt

SEQ ID NO: 94142 - DNA, 454 bp, Homo sapiens
ttagtaaccttcacccaatggttttagcatccattaatgatccttgcttcaatcactaatgtgatggttaaaaatggtgacttttctgtcattccttctacatttattagttgacattcagtagagtttcgcctgaattttaaacctaacaaaatacgatttcttttttgttgttgttaatgctgagtcttgctctgtctctcaggctggggtgcagtggcgtgatcttagcttgctgcaacctctggctcctgggttcaagcgattctcctgtgtcagcctcctgagtagctgggactacaggtgcaagccactatattgagctaatttttgtattttttaagtggagacggggtttcaccatgttagccaagctggtctcgaactcctgacctcaagtgattcacctgtctctgcctcccaaagtgctgggattgcaggcatgagccaccgt

SEQ ID NO: 94143 - DNA, 835 bp, Homo sapiens
agcggagtttccaaagacagttgtaaacccatattcacagcatcattatctacaggagtaaaaaggtggaaacaactgaagtgttgattgacagatgaatggatatacaaaatggagtctcctggtctacccatacaatggaactttaggccttttctgaaacactacaacatggatgaaccttgaaggcattatgtggaataaagtaagccagtcacaaagacaaatattgtctggttccacttacatgaaacacctagagtagtcaaattcactgatacagaaagtggactggtggctgccagggattgtggaagggagaaatgagagttattatttaatggctacagggtttcagttttacaagagaaaaacattatggaaagagacgttggtgatggttgcataattcaaatgtacttcatgccgctgaattgtacacaaaactagttacatagtgaattttatgttctgtatgtcttactacaattagaaataacttttaaacaatagctgatggttatgaagcttgtgttatggggcaataaaaatgctctaaaattagataatggtgatggttgtataactctgtgaatgtactataaaccactgaattatacacctttaaaaagaataaaaggccgggcacagtggctcacacctgtaatcccagcaatttgagaggtcaaggcaggcagatcgcttgagcccaggagtttgagactagccttagcaacatggcaaaatcctgtctctacaaaaaatacaaaaattagccaggcctggtggcacaagcctgtagtctcagctactcgcatcgctgaggagagaggat

SEQ ID NO: 94144 - DNA, 715 bp, Homo sapiens
gatcgacatgagatacagacgagagattatgtctcttatggctttatcatcaattaaacttagcaaagtctgttaaatttatttcagagtctcccagctgtgaaaagtagagttccacttatgtcatccatatctgcacagtaatcttttttttaatcctaaactttcttaacaggtttcttctccttattctagacaataatgctatgtgttttccttgaataccatgattttaaacttttaaaatgtctcagccttcatctttccaatgcagtctaccctgtagccttcacatgaaccttctatatcttttcactttcacatccctcccagcaaagaacattttgatcattagttaaagcaacctcaccgctttctcttttaaaactgtttctcttagaatccacagggaagctgcatctagcacagaagctagtatgattggctttccattgctagttactgctttcagcctgaccctggatgccacctagtgttgagtctctgataatgaaaatatgaaaccataaattacatttcataatttaacaatgccatctagtatatgcatttggtatatgtccctgaacttgcagtacctttgtactccaaaaagttcggtcacttgcagcagtttacatttctgtgactcccttacgcttttggcatctggtttggaaaataattataacgttcaagcactcaccttttttaa

SEQ ID NO: 94145 - DNA, 304 bp, Homo sapiens
cacagcagaaagaacgaccgctactgttgactgaacatccattattcgttaggcccaaatcatgccattcatcctataaataaccctgtgaggtaaattttattttcctgattctgcagcctgggaagcctccctagcattgtttaggagatttattatcctttttaaatgaatattcctacagccactgaacctggaccctaaggacatgaacagacaaacacctgaccaagaaccaacagctccgtgtgaagcatctgcccctagatactttccatttgggagtcacattggaacttggtgt

SEQ ID NO: 94146 - DNA, 747 bp, Homo sapiens
attgagcggtcgtggcagaaggggaagcagatgtcttacatggcagtgagtgagagcaagcaaaggggaagagcccccttataaaaccatcagatctcgtgagaactggctgtcacaagaacagcatgggggaactgtctccatgttccaatctccttccaccaggtccctccctcaacacgtggggattatggggattacaatttgaaatgagatttgggtggggaacagagccaaatcatatcattccaccctggcccctcccaaatcacatgtcctttttacatttcaaaaccaatcatgccttcacaacagtcctccagagtcttaactcattccagcattaacccaaaagtccaagttcaaagtctcatccaagacaaggcaagtcccttctgcctgtgagcctgtaacattaaaagcaagttagtgacttccaagatacaatgggagtacagacattggtaaatgttcccattccaaatgggagaaattggccaaaacacaggggctacaggccccatgcaccactgcactccactgtgcaagtctgaaacccggcagggcactccttaaattttttttttttttttttgagatggagtctcgctctgttgcccaagctggagtacagtggcacgatctcggctcactgcaacctccgcctcttgggttcaaaggatcatcctgcctcagcctccggagtagctgggctactcaggcgtgtgccaccatgcccggctaatt

SEQ ID NO: 94147 - DNA, 617 bp, Homo sapiens
ggagtaacttggataaaggccagacggggcttcctgtgggtctagtgatggatgttttgctgattatctccctcgtttgtcatttccgagatcagaaagcctttgcgaggggtaaatcttggttctagacattccggctttggaaggcttgagcaggacgggtgtgaaaactgaagctgctcggcgtccagtgtgttcccaggatatgtgcacgagggagcggcggggacagggccggggccagcggctcatcgctgaccctgcatggggtggtgtgggaaggagaggggccgggcccagcccctcaagtcataaatacacgaggcagactaacgcatgcgcgcgccagctcactcctggggactgcctgtctggagcagcatgtgcggctgagagctgagctgcagggctctgtggatggcacagctgtgccaggggagagccgtggcatctctgagaagcgggagggatgtgggctcccccgtgcagctgcaggttcagggctcactggaggaggcctggaggtcgggctccggggatgtgcccggtccctcccatgaggcaacccctccagtgtcctctgagggaagagccacataccggttccccactcagcc

SEQ ID NO: 94148 - DNA, 411 bp, Homo sapiens
caacaaaatatacttacagaatgaattaatgaagtttctaagaacttcattcataaccctggttcataaagaacattttcccacataatgccttctattttctctaggtcagagggtggggaaaggctcttactggtagctattactcaaaatgaacacaggaggtctccactgccatgccttggcctaaaatggccttggttttccttggaagtcatctgcatctgcctctcgtaagactattaacttagtacttaaggtccagaacaaaaatagaaaatgtttatgtgggccgggcgtggtggctcacacctgtaatcccagcactttgggaggctgaggcgggcgagtcacatgaggttgggagtttgagaccagcctgaccaacatggtgaaaccccgtctctacta

SEQ ID NO: 94149 - DNA, 770 bp, Homo sapiens
agcggtgttctcggctcactgcaacctctgcctcccgggttcaagcaattctctgcctcagccttctgagtagctaggtttacaggtgcctaccaccacacctggctaatttttgtatttttagtaaagacagggtttcgccaccttggccaggctggtcttgaactcctgacctcgtgatccaccctccccggcctcccgaagtgctgggattacaggcgtgagccaccgtgcccggccaacactttgtattacaatccctatatgctttgtaagagcattgcccttgtctttttaaatcctaactgccacttactagtagtatgatcaggaacaagttaattaacttatctgaacctcagtcctagtatctgtaaaactggcatatcattacctagctcacaagtttgtgaagattaaataaaattcatttatgtagactaaatacgtgttggtttcccttgtcatgaagttggtcctgcttttctcttgatcacgttcctttaccattttcctggtgttattttgattctttgatcatgattactatgagggattatcacagctaggtcctactcatgcaggcaaggaggaggaattattcaatccaattaatcccaggctctgtatcctcaaggaatggagttggtagtttaatgaaacagattacatgaattctttctatttaacaattacaggtttcatgacaacttttgaagaaatgtattaacttgggcccaaattggtatatttctaaatatggagccata

SEQ ID NO: 94150 - DNA, 405 bp, Homo sapiens
gttttatattttttaatacttacatcacctagttatctaagtataactcatttccacaatgtgaatacaatttttctcaataaatcattttgacatctctgaatctcaggttaaacagtctctcctattattaaaaagaggagcctgaaccaagtgaacttatcattgcagtcaccatcttagtgtccagagagagcaaaccagcaaacttcaactatccctgactaagcgtagtaccaaccccttcaaaggcccggcaatgcactgaaagccaggtgagcctgctgacgacacagtaacaagaaggccagagtttattgaatcacagaataattcaatggtaggctagcactgggctttaatgagcatcgcgtccagccttctcactctgggaccttatgatgt

SEQ ID NO: 94151 - DNA, 456 bp, Homo sapiens
taggaatccaataccatactgtcagtttaaagagaggttttttcctccttcatttaaggaaagtaagattactgcaagatgtttctagatttccttagtttgaatctaacagtcaaaacacattttagaaaatcctacatagtacttttctggaatctaatccataccacgtatgttgttgctattaccatgcggttttaaaaaaataacttaagctcttctattgtaactaaactatacagccttgaacaaatcacttaaccttaccacatggttagttttctcatctttctcatctttgacttttttaaatgactataaatgatgagactatctaactttaaaacactacaatgcaaaaattttttgtaaagtgctatacaaacaacttatagcatgtacttacaaattaaaagccagatacattttccattaaaagatagttttaaaaacagt

SEQ ID NO: 94152 - DNA, 674 bp, Homo sapiens
aaaaatgcaaaggcctatagaacgacttcctatccctagcaaaaattcacacagaatcctgtcccctgcacgttttaagtggaaaagaatgaccccagaaagttgatttaaaactaataaagctgtttattatcattaatgataatttctgtataattgtcacggagagcttatgcatgaatctgtaacttgtcgttattatggtcttcactagaaattgcatgtcttttttaatttctgaaataaattattgggatgaagagcactgtcagtttttgtattaaagtgtttcagtagagcgtggccgaatatttgacatgatgaatctgaatgaaatgatcagagctatgtgaggaatatggttctacgctggatgttttgtggacaaaacagaaaaaaaatcccagcctagaagcattattgaaattgcatcgaggaaaaactataatctgggggtcatactgtcactctgagagaactactatgttctgtctcgctttctcatcagaggaaatccttgtaccatgttggtcaggctggtctcgaattcctgacctcttgatctgtctgccttggcctcccaaagtgctgggattacaggcgtgagccatcacgcccactctgatgcttcttttactgcgacagtgaaatcagaaacagttgtcagggttgaa

SEQ ID NO: 94153 - DNA, 308 bp, Homo sapiens
agaaggcagaggggacagcgcccagtaggcttcccttccatatttgctcagcaagtgtttcctgaggcctcccccgaagccttgtgctgggcggtgctgggagtggagaggtgattttgatcttgccctgctctcaaggggctcccagtctggcgggaaaacaggcacagacgcagcttgaggaggacgtggcagcggtggtgccatgctgccaggggctctgcgtgcccttctcttgacggaagggtacagatcagagctgggtgttcagaatttctctccgaggcctgtgtggaaggaccaggaag

SEQ ID NO: 94154 - DNA, 448 bp, Homo sapiens
ttccaggctcatattgtacttaccctgtcctagccctagtccaaccatttctcctaagagtcctggttctctttggtgagaaatggtatcaaagaccaaaattttaggtgttagggcatgtgttagatcatttctactggggtgactttgcttctaggccacttttgcctatagatggagctaggaaatatatgcatgtacatatatacatacacatacatacatgagaacatatacatgcatatgtatttgagaaatcctgagtctatgccattacttttaattccattccatccccacagggtatccctcactatcccaattcatatttgtatgttccttcttccactgagaatgctggaacctaataacatcaacatacttattcatttgctaaatcctgtattacacataaaagagcttcagaattgtttcagccatttcaact

SEQ ID NO: 94155 - DNA, 171 bp, Homo sapiens
agatccaagtccaaattggttaaggtaaaggatctacagagttacaagataagaaaattatgtgaggttatgcaggaaaatgcttacagctcactttgcaaagacaaaaagatatgagaagaaatttagctgattaaatattgatgagttctccttctgggacactatgta

SEQ ID NO: 94156 - DNA, 439 bp, Homo sapiens
ccactgtggcctcatcatccacctacaggtggacaggagagagtgaaagcagaaatccagtgagtcagtttcgtagctgccaccaaaagtcacgcaggagaagggagagaagttcccaggagacttccagaggtcctaccctagctaggcctttatgacacagaggggctggggctgcctatggctagggtggtaggggcctgctgtgtactacctggtcagctgcccgtccccagagcccaacacgaggactgtcctagggactggagcggaagccacagaaattccagagcccaaggcctttcctggaacacctccaggttgaccagcagcctagaaaactgcccaggaggggtgtgctgattcttgcacttatgacacaagcccacggagcaggaggcagctggtgtagagattaggagcacagggtttgaggtca

SEQ ID NO: 94157 - DNA, 394 bp, Homo sapiens
ttttttactgtaggccgtaaggccctttgaaccctcgatatataatacttgctcaattatgtttgtttagtaaaggaatgattccatttgcaccataaactctcttcctgtgaccagcatatgaatgtgtgtgtggtctctaagaactcgaatgatgcctaagctatccaacccactttcctcagtttttatttacgcagaaattgaaattaacaaactaatttctgagtcttaagtgaaattgttttcgttttatttaaagttacccttgacttacatagttttaaccttctggaaagttcttcttttttctctctctcttcctgttcctgattgccacactggatagaaagttctaaatgaatacttaggtttgaaagtatttttctacatc

SEQ ID NO: 94158 - DNA, 561 bp, Homo sapiens
ggaggggccccaggttgtggtcctgcctcccttgtgccgtggtgtggcagccatggtccgtgcctttcctgggtgcggggcctaccctgtgtcaggtgcctctccctaggatcagctgtgcaacttggctttggcattggcagctgtgtgggagtggccagtctgagcagcagcagctgttcccagtcccttggagagggcaggactgggacagtaggggcagcactcttatggccctgtccctcatctctggcagaggcaaaaggaagctagggaaaagcaacatgaccttgggagccaggccacccaccatgcccccctgcagccaggcctcccctgcaggcctccaagagctggacttgccgtctcagcatggatctgtgctgcccctgcccctcacagttctccagagggcagggagagccatttcctgccacctgtccttgattgccatatggccacctgaccttcctgaggttcagtggggaggacagtaaggtttggctgaggtaaccctgtgtgagtggtgtcgtggcttttggtgcttagccctcagcccca

SEQ ID NO: 94159 - DNA, 403 bp, Homo sapiens
cctcataaatcagtaggtgggaaatctcggcggagaaatagaaaccctaaaacaggaactaaatggaatttctggaatggaaaaacacagtagatgaatttttaaaaatctactagatgataataatagattttttaaaaagtcagttaacttgtaaaccaatagaaattatccagtatgaacaacagaaataaggataattgggggaaaaaagcaagcggagctctcgacccgtgggacaatgtctcaatatccagcatgcatgtaattagattttcaaaagtgtaagaatgacccatcagccacatgaaaggatgaacaacatcgttagttagcagggaaatgaaaattaacactacaatgcgatgccatcacacatccatcaggataaaaattaaagact

SEQ ID NO: 94160 - DNA, 379 bp, Homo sapiens
ggattttttggtctgttttggctgctataagataatgctatagactcagtgacttataaacaacagaagtttatttctctcagttctggagggtgggaagtccaaggcactggcaaattcgatgtctggtaagggcctgctttgtggttcataggtggctgtcttctagctttgtccttatgtggtagaaggggtgaaggcgtctctggggtttcttatatgaggtcactaatcccatttgtgatggctctgccctcataacttaatcacctcccaaaggccgcactttcaaataccgtctcgtgggcggagggcgtattgggattttaatacatgaattttaggagatggaaacattttagtccataacatacaatga

SEQ ID NO: 94161 - DNA, 240 bp, Homo sapiens
cggtgccttgatctcccttcttagctacttcaattgactgataaaaccaccctgtgatggtaataaccaggttcccaagtgcccaggaaaataagtcctaggggtggacttcatttaaagcagactgtggtttctgcctcagttccctcttgctcctggttggattacacttgctgcccaggggcccaacagaaaacagagaggcgctgcttccctccacctccctgagttaatggtgta

SEQ ID NO: 94162 - DNA, 356 bp, Homo sapiens
  misc_feature (211)..(211): n is a, c, g, or t
  misc_feature (225)..(225): n is a, c, g, or t
  misc_feature (263)..(263): n is a, c, g, or t
ctgtctcaaaaaaaaaaaaaaaaaagtcagaaaattaagatggagaaaaggccaaaaggccattgtatttagcctgatagtaaatagatcattgatggcatttgagagagtgattgtgtttgattgattctaaagaatgtcttaagtattcagtattactttttacaattttttaaaattattaatacaattcttccatctctactaaaantacaaaagttagtngggcgtggtgggaggctgagtcaggagaatcgcttgancccgggaggcggaagttgcagtgagccaagatggcgccactgcacttccagcctgggcgacagagcgaggcgccgtcttcaaaaaaaagaaaa

SEQ ID NO: 94163 - DNA, 228 bp, Homo sapiens
gtatttgcttatgtctaaggtccctgtagttgtggttcacaggattggggctgctcctgagattcagcaccacacaggcactgcatggaactgtgctatggtggtgggcactcgctttccagatagggcccatgttgccagcaggcatgatgcatcatttaccctaccctgagtgcaatatgtggttttatagaaaaaaacttgggccagatgcggtggctcacacct

SEQ ID NO: 94164 - DNA, 411 bp, Homo sapiens
gccctgctaatttgtgtatttttagtagagacaggatttcaccatgttggccaggctgggctcgaactcctgacctcaagtgatctgcccacctcggcctcccaaattgctgtgaatacaggcatgagccaccgcacacagcaagattttctatttcttcataattctgtcttggtaagttgtatgtttccagaaattaatctatttcttctagttattcaatttgttggtgaatgattcttcatagtagcctcttaagattctttgtatctttgtggtatcagttgtaatgcctggtcttttagttctgattttatttatttgagtcttctcttgttttcttagtctagctaaaagattgataaaatttgataaaattcaacatattttatcaattttgtttatctttgc

SEQ ID NO: 94165 - DNA, 1349 bp, Homo sapiens
ccctttgcactcaggacaggggtgcctccagcagacagggtgctcaatgtatgtttgttgttagtaataactataacttattgggtgatggccattatttactatgtaccaggcactattctacacattttatgtatgtatattaactcatgcagttctcataaggaccacaaaaagattgtcctcatttttaaaatgaaaaaagcagtcacagagaagttaagcaactttcccaaaggcacatagctagtgatatggtttggatctgtgtccccacccaaatcttatgtcaaattgtaatccccaacttggaggtggagactagtgggaggtgattggatggggccgggggcagactttccccttggtgctgttcttgtgatagtgaataagtgctcaccagatcaggtttaaaagtgtgtagccctccccattctctctcttcctcatccagccatgtaagacgtgcctgcttccccctcaccttctgccagggttgtaagttttctgaggcctcccagccatgcttcctgtacagcctgtagaaccatgagccaattaaacctattttctttataaattatccagtctcaggcatttctttatagcagtgtgagagtggactaatagagctagttattagtagagccaagatttaaattcgagcttgctggctcccgagttctactttctcaaaccctatgttaagctattgtccacagcattcaacattgttgaattatctttgtcaactaaccttggaagtcttaaattttgtcctaatcctgtcccctattccccccaccttagtcttctccatcactcaaaccagaacattaggaatcctctctttccttacccaccccctctgatccatctccttctatacacatcaatcctgaatccatccagctcctccttcccagtgaccctgcgctgaaccagtccaaaccatcatcacctttcatctggactcatgcggtcacctgctgacttcctccaggcttcccctcctgctgctcacccccatctatcctccactcagcagctggaaggattaacgcataaactaaacaatggtaatcctggtttataaccccataaaggctcctcatagactgggcccggtgactcaatcccagcactttgagaggctgaggcaggcagatcacttgagggcaggagttcaataccagcctgactaacatggcaaaactccatctctactaaaaatacaaaaattagccgggcgtggtggcaggcgcctgtaatcccagctactcagaaggctgaggcatgagaatcacttggacccaggaggcggaggttgcagtgagcagagattgtgc

SEQ ID NO: 94166 - DNA, 199 bp, Homo sapiens
accactgggtttgggggctgctcatgcagggcagcagctgagctcagagaccgcagctcccctctgggccttggatggagcaggtggctgtgggtgccgtggctcagtctcagtggcacgcaggcagtgctgaccaagagggcacgtggtaggcagggagcacgtgttgtgtcattcatcaccatacctcagtgtctag

SEQ ID NO: 94167 - DNA, 446 bp, Homo sapiens
gagaatccaaaaataaactctacttacttcaggcagtggagtaaatgcctgggaacactttccttggagacagatagatctgccatctcagcctgactcagcctcccacgagctgcatcagcttggtcaaactgcttaatgtctctgagactgtggttcttcaggtgatatgcgggaaaaataatacacacctcataggtttcctatggtgaatgaatgaatgaatgattatgtacaaagtgcttagcattgtgttgggctcaataagtgatatttattatttattattattattctgagcttgcttaagtatagacctcaagaggatcagccaagactagtgtaccctttggaaatatcgtttctagggacaagaaaaatgtcttggaataagactccataaatccctctttcattgtgcctgacagagttaaagcagcttcccc

SEQ ID NO: 94168 - DNA, 871 bp, Homo sapiens
tgcgggagtgtggggttatgtacctcctcccattttcctgctattcagcataaaattatatgctttttgaattttatcatcttagttactaatattcagcattcatatggtagtcagaggttaatttctgctactgaaatgctaagaagcaggtagactctttgtggtataagggtttctggagtccttctacctggactactgcttctctttctgatatcacttctaactttgttactttccatccaaacgtgtgtgtgtgtgtgcgtgtgtgcgcgcacgcgtgtgcacgcgctgtatctgtgtgttttaatcagatgcttcctaagatattgcagtctttgctcacataaactttcaatagttctgtattatctgcttgatcagactttaactccttaagatgaagctcacagctcttggtcatctgattgctacacatctattcatctatttctactgctactcaatcaaatcactatattcccattatcctgactggagttggaattttttctagactagaaagtgtcccctgaaaaatcatcatcatcttcacctcacctcccattctccaaccaccatacactctggcttttcttcatttagaatatccatcatctcatttccatacataaaagtcccgacccctatttacaacctaattaaaaccataccttctcaaagcttcccttactgtaccagtatgctaacatatataatgtttattttcttctctccctattgaggttagacaggaatgtctctgtaaatgcataggagtgcttggtttcttcaagaaacaacaaagtcaatatttttgtctattcatctaggaagtgaaagtcagcagagagaattagaagaaaaa

SEQ ID NO: 94169 - DNA, 397 bp, Homo sapiens
aaaacattgaactaggaatcccgagacttaagcttgagtcctgacccaacctataaattcactgtgtgaccttgggaggcttgcataacctctctgagctttcccttctttgtaaattgcacaatattaccttcaaatgtaatcatgtgagaaagaaactgcagctgcttcttgggtttagagctgcagcatctgtgtgggttctcagaagtaccatagccctgactacaaattatctcatagccaagagaacaacctcatggaactcgaaagttgaaattcactcagtctgggttttttatatttattctggggaacttttggggaaatgactacagtcaaccactcttatgcaacaataaagacgcagacattttttgaaagaaaactgagttct

SEQ ID NO: 94170 - DNA, 292 bp, Homo sapiens
gtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtggagcttagagagcacagcactgggatgtgaagacatgggttcaaattgcacctctgccatgttcagctgtcaccttgggcaaattacttctctgaaccttagttttctcatcattaaaatgggaatattgg

SEQ ID NO: 94171 - DNA, 1451 bp, Homo sapiens
aatcatttgataaaatttgaaagtgcagtcagacaaggcagtcacttaaaagcaactaaactgtgatttgcttgacttagtttctcattttctctgccagagtctgcaaataaacactctgatatcagagcaaacttggtaaatacctctgtttatatacaatataaatatacaatataaatcatgacgtatgaacgcctaaggtatctgaaagagttggtatttctaatatttcataaaagttaaatatctagagaatgcattgcttttgtcacttttaatttttatattaaccctcctaaactagttacctcttttattcgtatataggtaaaacaaacgatgagccatttttatcaaataagcaaggtattgagtaaagtgtaagcatatagtatacaaattgtaaggtaaaatggcaatttactgtgtggcaccaggtatttaaatgtgcactgaaaaaatttaatgtatcattcaagtatgtgctttagttatttagcgttcgttgttattttaacttcatgaatatgctgccatttattctttggaaaaactgcttgatctattgtatatcaaaggcagcataatttctaattcagtcggcatacatgttactaacaacaattcctctttcacattagcttaatttatataatgatcttgtcattttttcctcattatgtaaattgtgctttcttcactgaaatattaagaaaaacataataaatatcttcctatgtttttcaaaatagtcctgtcttaggctcacaaatgaaaatttattcctacaatgaatttttgttctgtttttgagacgaagtctcgctctgtcgcctaagctggagtgcaatggcacgatctcggctcactgcaacctctgcctcctgggttcaagccattctcctgtctcagcctcctgagtagctgggattacaggcatgcaccaccgtgcccagcaaattttttgtatttttagtaaagatgggggtttcaccacgttggccaggctggtctcgaactcttgacctcaagtgatccacccacctctgcctcccaaagtgctggaattacaggcatgagccaccccacccagcctctataatgaattttgagtagaaaatttgatgatggtgtggaggcaggaataagaactaaggatatttttctagtattccatttttaaactggcaaagttagattaacaagagtcacaaacttctaattaacttctaattctgcatatattttgtggaaaaaatcttaaaattcttagaaagttcctgcttattaaaaagtttaagtctggccaagcactgtctgtctcttaaaaaaaaaaaaagtttaagtcaacaaaagatttaaagcatacttgttatacatgtaacaaacacaatgggtaatgaagtaaaaagcggttctttttaagtttataaagaccatagaacctt

SEQ ID NO: 94172 - DNA, 550 bp, Homo sapiens
tgagaaatcctgcatatagctatcctgaggttttctacttgatgtttacttcttgccctcacccagtatcattttgctgggtgtgctctgttccatttatattcatctcccgaccactgtccgtatctttctccatcagaatttttctttttttctaatttattaatcaagagaacaattttccactttctccatctcttgtctgtcttctcataaatttaaccagctgtgtgctgaagctagcttaccctggttcatgtggattttgtgtatctcttcccagttctgcattcagtaatatcacgttggtggcttgaaattggacagggtggtagtaattatcccatggaaatgtaaacgctacaaatcagggctccccatcctcccaccccagaactagcataccactgaattaaccttttagcctgccttcactcaaaaacagctttgtaaagaaaacattcgtgcagaataacatgttttcattaggtgaattcaagtaaggatactgtgaaagtttcagcagccatagcctagtctggccaacatg

SEQ ID NO: 94173 - DNA, 384 bp, Homo sapiens
agcagatccaatgagtgtgcgtttttgctctgtggcattaccatcagattgacatatttaattatcagatatctttcttttgccaaaaagttgtggttgagttggccctgggatttataaatacatgcacacagcacatttctgtcattgttcactgcagtcttttaacacatcttctcagcaatattcttaatgtttccagcgggaaaattgtaaattatttaaccactgaattagaggtgtgttgttttttagctaatcaatagccattgaatgcttaaatgggctttaaagtagacaaaagtaaaagacagcaaagaaaattaatcagtaagattgcccatactccatagacacttgagcagctactttagtcattttgaa

SEQ ID NO: 94174 - DNA, 433 bp, Homo sapiens
tgtttgcacagttggcagaattgggcacccacttgtgctttcatttgaacatactcagaaggtaggggtagagctgagggggtttacagcctttactgccagtctctggagaccaccaatatgtacaacaaaaacaaacaaaatcaaacaaaatcccaagcaaacaaaaacctaacaattgttaccaccaggctatagatacagtgagtgaaaacatcctagctcagcaaggagggcagatatgaaagagaacaatcttcctctcccatctccctctccactacttccacacgcttgtggtgaggggggagaaaacatttaaaatgaagaggataggttttaaataagcagaatgagatgattttagtgagtgaaagtggctgacagttatgaaagaaagactgagagaaacttatgaaggagtctttaaggg

SEQ ID NO: 94175 - DNA, 791 bp, Homo sapiens
gtggtattaagaggggaggcctttgggaggtgattaagttgtgagggctctgccttcgtaagtgagattaccccttataacagagacctgagggagcttgtttgccccttccaccatgtaaagacacgtgcaaggtgccatctatgaggaacaggcccttagttgacactgaacctgcaggcaccttgatcttggacttcccagcctccaaaattgtaagcaataaatacctgttgtttataaactacctagtgtaagttatgttgtcatagcagcctgaatgggctaagataatccatatccccttggaattgtactaaacatcaccttgaagttgtattataaatgtcagaatcccagtctgctattcactagctgattggcttggggaaaacttgtttatctctgtagccctggttttgtttaccacttaatagtattcacctcattgggctgctggaagactgaacaagccagtatctacaacatccctgagccacatctgttgggtattagcggtccatgagggttaattgcctctctttctcttctttttgcatcacatttgaagttttgacattttaaaaaatcgcaagaggttgcttcaagctttgggatgcatggcaaccttctcttgaggaaaattcattcgaatgttttgtgtgctcaaaatatccgttattacatccgagaatctacagtggactttggtgaaaggttggcccaaagcttagaacggaaaaaattaatttttccagagaggcacgactcagaatttattcctgtctaaa

SEQ ID NO: 94176 - DNA, 570 bp, Homo sapiens
cggctgccaagttttctccctgctctgctccagtgacctgggaaaagcttaatagactgcccattttagagtctccacactgagtgtcctcagcctgtctctcaggaagccctttgacatgtttttaagatcctgtgagccatcgttgtggcttctggtttctctcggcccagagctaaaacaccccacctgtttgccaccagacagaaaaatgtctgtttgttcaggcctttattcctcttatcttactgtgcactcctttccctccctctgggaagccagccagacacactgaggaaatggcttagttttctcatgtaaaaacaacaaaatccattttttgaaagaataatataaaaacgtatgatgaatggggaaaaaaccaactatacaaacataaatattacttctgtacatttgtcttctacaattagctttaaaatcatttttgtttgaacagctgagatatttggtactggccaggaaaactggagcttagagaaggggtatctgtttccaagacattctctctatggtgtcatttacaaaagacttcaaatcagcattaga

SEQ ID NO: 94177 - DNA, 492 bp, Homo sapiens
gtaatgcacacatttaatgactaggtgttaaatattggtgattatgttgattgtactgtagctttgtatggtacattacttcctaaggtattcccacaggcaggacactagatcttggaaaacactaactttatcagaatcagttcttgatgtgacactgactgtatttaagtcaagataggttttaggcaggaattggagctacaagcagcgtgttgtagatgagtatttttgttgtgttacttcaactgtcatagtttctaaagcttagaaataactagttcacgacctttgtagcatcattatgtgagaatttattgagggtatgataatgaggggcttattcatactgttaatctggctctacacaagtgtgactagagcatgtttttgttttgttttaagagatggaatcttgctgtgttgcccaggctggagtgcagcagctgttcacagacgaggtggtagcacagggaagccttgaaccggact

SEQ ID NO: 94178 - DNA, 701 bp, Homo sapiens
cagaagaagaaattctgctagcagactgcctttgctcccctccctggttctccagcctgctggtctaccctgcagactttgactttccaagctgccacaatcatgtgagccaattccctaaaataaacctctctatatatacttgtatacatcctgttgattttggttctctggagaaccatgactaatacaactgggcttaacattttatctggagctccgaaagaagctgaggtcttcaccaaggtattatgaaaggagcaaagggtgtcctaagaatatctgagtgtctgcaaggtgtttaactcgtgttaaagggtttgtgctgggcagaggacaaggtactttttttttttttttttttttttgagatggagtttttctctcgttgcccaggctggagcacaatggcacgatcttggctcaccacaacctctgcctcctgggttcaagcgattctcctgcctcagcctcccgagtagctgggattacaggcacccgccaccacaccccgctaattctttttgtatttttagtagagatggggtttcaccatgttggtcaggctggtcttgaactcccgacctcaggtgatccgcccgcttctgcctcccaaagcactgggattacaggcttgagccacagcacccagacaggacaagatactattttgaagggtatgtgcttcccaggtagagcat

SEQ ID NO: 94179 - DNA, 315 bp, Homo sapiens
tcaagcgatcctcctgcctcagtctcctgagtagctgggactataggcatgctccaccatgcctggctaatattttaatttcattttatttttggagacagaatatgttgcccaggcttgtcttgaactcctggcctcatgctatcctcccaccttggtctcccaatgtgctggcattacaggtgtgagccaccacacctgtccagattatttattaagaacatgtagaaataccactgaattaactatacttgtctttgaggccaactttattcatttggccaaagtgaatatcaccatttaaaaactgtggaa

SEQ ID NO: 94180 - DNA, 640 bp, Homo sapiens
atctgaaaaaaaaaaaaagtttatttacatgggtaaattgtatataccctattttctcccaactctactattaaagataaaacaaaactaaaacaaatttatgaaagccatgtcaccttatcaaaaaagtaaataatttggaaaggcatatttttaatatcaccaaaattcaactcttttcccttaatattcaaatcctatttatatataatattttaataatcctaaagttttagttacaatttcattcaaaaattccataggaagttgttgatatggataagaaatagtttttgggaaaaatgagagctagtgaataatatggataaaatcattaaaagcttttttagtgcccaggaataatatgaaaaataactagatcagtaagtaaaggtgagttaagcagtatcgaatgacctgaaagggtgattaggatgtgaattttcaaatttgctcaggtatcagatttcgacatttatgtagttgtacaaaataaaggacttactgagaatatccagaatgtagggactagagggttgaattggggttacactcagaccttcacagacttatctggtggtctacttttacttctcattcttccctttctgccctctcacttcttatctttaccagtcag

SEQ ID NO: 94181 - DNA, 199 bp, Homo sapiens
ggttattttcagtgaaagccctggtgccttgatccacaaatttccccccactgaaggccctttttcaccacctccctactggttatgtgtagcattagggccaagttcatgccccagtgggctgctcatgcacttcaaggacctgacttgtagaggaaataggcttagcctgtccattgcttgccaccctccacaccag

SEQ ID NO: 94182 - DNA, 1014 bp, Homo sapiens
aagatgtcctaagccgaacaggacttaggcttaacaaaggaccaaactcttcagggtgactgacttgggtgggtgtgggaaagcttactttgtcttgacttcagcagttgcaggcttcattcaaactgatttttttctcacatcttactcatgttaaggagatggaaataggcccatattttcaacctctgccctgcatagatctcaccaatgaaggtggggctgtttcagtatcaataaaaatagcatagtgaactatagagggaaaatcgtgatctagagacatgcttcagtgtcatcaagactggcctccatagctgacatttccccacctttactggggaaagctgagtaataattagtccaacagtctggtgaacagggaggtacttttcatagagccctgtcaagctggcctcatccctgcttttataacccccagctaaaccaaaccttgctgcccctcttcacgtttgcttggtaaacagttccttgtggaaaaaaacaacatccccactatcctcaagtccgccacctacctcatcctgtaggcactgaccaagagcaacaactttagaagctcacgctaaatatagtttagggcacaccatggtgaacaggtggacagcaagaagcctgtttccatattggtgtaccatatgtatacaaacacaggtactagattggtgtctgcttctgagtcattttcccagccaagtatagaaattttgtagcaaaacccatgtgcttcatgatcatgagtagttaagccttgtttttctatcaaagatccccgttaagtgaaagggacccacaaaccttcaacttgtcattttgtcaatataccaaaaataacctttctttttacctttactgtattacacagaagtcaatcatcttccttgcctcccgctctgaactttggagtggagaatgagccatttggggactatggggaaacttaccactatgtgtgaaacttaacattacaagttctagtccttgttctaaaca

SEQ ID NO: 94183 - DNA, 446 bp, Homo sapiens
tggcactggtcgaaaattgcactattaatcaacagctcacccatcaaagacacagaaatgcagacagagactgcaaatggccaagccaacgtatcaccattgttaggagaaaacaaaaaccaaatacttaaacacagatggctccagaccaagtgtgaagacagtacattggcacgacaagggctaaagtgttttataaaagataatttaggaggtagggctagagtctatcttgctcaacaaatgaatctgtacagacctttgccttcaatccccaaaacagatgagtaacttacatcattaatctcattgtctctccacacaatacttttaacagtcaatcacaaagtagcctgagagaaagtttccctggatactaccaaacacacaggtttgcaacagatgtctccatgcaacttttaaaacagattccatgttaagaagtt

SEQ ID NO: 94184 - DNA, 801 bp, Homo sapiens
tatccactgcactaatgagtccttctcatctgggtcaggtatcaggagtggacaaggggataccaaacatgtcatttgcagccacttaaaatacttgagtggttacaaagatcattctctgatcattcaatataatgagagcgtttcttccctgtttgatggacatttatgcttcagtgaggtgttatatagaagactgataaagtagtgctgatatgtgctgttaaaaaattctttcctggccaggcatgatgtacatccctgaaagtataccaaaagggtctggaaggagacacattacctgttgatagaggtcatctatgcagagggggatggaggcagaaatgatataggaaggagaaaagatgactttcgccttgctcttaaatatgcttctgtactgttttcaatttaaataacagattggcattatttctacaataaaagtgcattgacaaccagcatatttttctttttttttttttgagacgggctttcactatgttggccaggctggtctcgaactcctgacctcgtgatctgcctgcccccgcctcccaaagtgctggaattacaggcgtgagccactgtgcctggccttaaaaatattttttcttcatttcctatcacctttagcacagactacatttctttttgtattctgagttcatttctagactctgtttatacatcagttcttagagtatcaaacgatcttatttattatatctttgcattatgttttaatatccatcattagtccaccttttcagaagttttttgacaatgtgtgcatgtttg

SEQ ID NO: 94185 - DNA, 858 bp, Homo sapiens
accacaatcttaggtacagaaggcagtagcaggccccagctgctcttcaaggagacatacaggcatgagcagagggccaaaatcaggaaaagcttcatgccctccaaataatgctcaaatggcagaaaaacaccagagtacattgcttcttgggctccataacaaaccttgtccattataaggctcctgattagtgaggagaagaaaaaaaacacactaaaaaagttaaggagcaaaacatcacaggactaggacagaatcctatcagtgcaaaaggaagaagtatatagttgtatttgggggcatagatgtacatccctgaaagtataccaaaagggtctggaaggagacacattacctgttgatagaggtcatctatgcagagggggatggaggcagaaatgatataggaaggagaaaagatgactttcgccttgctcttaaatatgcttctgtactgttttcaatttaaataacagattggcattatttctacaataaaagtgcattgacaaccagcatatttttctttttttttttttgagacgggctttcactatgttggccaggctggtctcgaactcctgacctcgtgatctgcctgcccccgcctcccaaagtgctggaattacaggcgtgagccactgtgcctggccttaaaaatattttttcttcatttcctatcacctttagcacagactacatttctttttgtattctgagttcatttctagactctgtttatacatcagttcttagagtatcaaacgatcttatttattatatctttgcattatgttttaatatccatcattagtccaccttttcagaagttttttgacaatgtgtgcatgtttg

SEQ ID NO: 94186 - DNA, 437 bp, Homo sapiens
aggttgtaaagaccatggaaaaagtgtagtatctgggccggagtgcaccgttcctcagggcacagtctctcacgacttcccttggctaggggagggatttctctgatcccttgtgcttcccggatgtggcaaagcctcaccttgcttcagcttgccccccacagtctgcacccactgtctaaccagtcccagtgagatgagctgggtacctcagttggaaatgcagaaatcacctgccttctgcgttgatctcactgggagctgcagaccggagctgttcctattcggctgacttgccagccactccctcttctttcattgtataatgtctaaactgaggcccagggactttaattgcttatctaaagttaaaaatttcacaacccagccagcaatatgacccagtcccatacttctaagactgctttttcattact

SEQ ID NO: 94187 - DNA, 418 bp, Homo sapiens
ttccaaacacagttcaaatgaaaccatcaataggataaaacaaacctgtaaaatgtgtgcacaggattgatgtgcaatattcattactaatccaagagaagtaatgtgattcaattacttacatctctatatcaaatgtgatggcataatggctttatgccattatcaattaaaaaaaaataaggaagtattagtgtgctacctgagacctgcattccactcaaagcgccaagtagtttaactcatttttaagagataaagctctcaagcaataaacaacatgtaagtagagttcacattacctgaaaattgacccacaaatcatgtgttcatcctaagcaaactaactgagcttcatccaggccctggaataataacacccaccctggcatgagagaatagaggtgcttcaccccag

SEQ ID NO: 94188 - DNA, 388 bp, Homo sapiens
ctctctctctcttcctcctgctttcgccatgtgacatgcctagtccatttttgccttctgccatgatcggaagctccctgaggcttcaccagaagtttagtagataccagcaccatgcttcctataaagcctgcagtactgtgaaccaattaaacctctcttcttaataaattatcaagtctcaggtatttctttatagcaatgcaagaatggtctaatacagtcctgtgaattccacctcagtaatttctttcaaatgtatctcttctagtccattttaccaacaccataataatttagaaactcattattctaacctgagtacagaacccatgagtgggtatcaacccatcagtctctcttctgttaaaaagttttacagctctct

SEQ ID NO: 94189 - DNA, 235 bp, Homo sapiens
tttttgatgtaaaataatgttcaatcctgtctagaaattgctgtagaaagcaaactcttctcaaactttaggcagagctaaatatattttttcaatattcaaacagttatctgtatgttaaaataaattctgggccaggcatggtagctcacgcttgtaatctcagcacttggagaggccaaggtgggaggatcacttgaggtcaggaattagcgaccagcgtaggcaacatggg

SEQ ID NO: 94190 - DNA, 788 bp, Homo sapiens
tggctattttcactatttttgaaatggtcagttaacagtttgagatagatacatatacttttttgagacaaggtcttgctttgttggccaggcttggattgcattgatgcagtaacgattcactgcatcctcaacctcccaggcccaaatgatcatcccatctcagcctcccacttagctgggcccacagctgtgcaccacaatacctggataatttaaaataacttttttttctttttctttttcttttttcccgagacaagatctcagtatattactcaggctgggatgcagtgtcacatttatggctcactgcagctttgaccccctgggcacctcagcatgccaagtagctggggctacagaagtataccaccacttctggctaatttttgtagagacaggattttaccatgttgcccaggtcttgaactcgagctcaagattcacctgcctcggcctcccaaagttttgcgattacaggcgtgagccaccatggctggcaaaaaaatttttttggtagaggcctggtcccagcggattgcccaggctgatgttgaactcctgagctcatgtgatcttcccaccaggtagctggtaccgccatgaccagctaattaaaactttttttttgtggagacgggatcccactgtgttgtccaggtaactcctgggttcaagcgatcctcccactgtggcctccccaaagtgcagggattataggcatgaaccactgcgcccgtccagcttgatatatttaggtattgatatatccataatgacgaatt

SEQ ID NO: 94191 - DNA, 541 bp, Homo sapiens
ccatctcctgggctcagcctcccctcaagtgtagctggaactacatgctcgcaacctactaaatgttttgcttttttttttttatagagacgggttttcatcatgctgcccaggctggtctagaactcttggactcaagtgagttgcctgcctcactctcccaaagttctgggattagaagcataagccgccactcctggctgcaattttattttgaaggtaatgcaggacacaggatacaaagtctatattcagaggaagagaatgtatgtggtctaaccagacaccttccaaaataaatctgcaactccaaatgctaataccggcaagcataatggtataaacctgtcctacagaaacggacagttgagtagtgagattaaaagaacttcccctgaaaattcagagccacagccagcctttcatctggaattctgtattaccaaagtaattggaacaaacaaaaaaacaccatgctgagactttcaaggggtccttgagttggtagcaccaattcagagacttcatggaagcaatcacc

SEQ ID NO: 94192 - DNA, 454 bp, Homo sapiens
ctatagtgaggcaagtctgctagataaacggtagttcagcccattttcaaataaactgctatctgcacacaggtcctaatctatgtaccttcaacagtatctgtggtcatgagtataatattcatttttctagctaaggaagttagaaactaaagacagttagaaactgagggtgtaataatgattttcaaaaaattctaaaatttccatttcaatgagttacacaaaagcaattagagctatttgacaatattcatattaattatattttctaattctagaaaaagaaatgggacattataaatcagtaatcgtttgaaagattccaacttgagactttttaaaccaagactagaaaccaagaagccataaaagaaatgtcagacatattgaaatacacatgaagtaaaagcttctatggcaaacgataccataaaaaagtaaacaaacacat

SEQ ID NO: 94193 - DNA, 699 bp, Homo sapiens
gagaccttttcagggaaggtacaaggtcaaaactatcttctcaataatacaaaaacatttgttttgttcattttcatcctcccacaagggtatagcggagttttcccggggctacatgaagtctaacatcacaacagattgaatgtagaggcagacatgagaattcaggtacattttattaattcagacatttaaaaaatgaaaagcaatgcaattcttttcgcttttttctggtttgaaaaataagattttcgtgaaaaataactatgctaacatgtcatcttaacatgtaaaattataatttatcattgtaattttaaaataattttttcttcatttctcagccttcatttctaatccaataaatattgtagatatcacccacataaacaatagctccctagaatcctaaataatgttaaaagagtgcaaaagagtcctgagaccaaaaagtgtgagaactgccacgaaggagaaaagctgttatgtatgatgctactcaaacagagtgactgcaccaggagaatctaggccaggaaagggaaaaggaaacgaccaactaagctgaagaaaacctgaaggatgataagacctggtttagcaaacagtaagtggagccaggaggaatgcactaagctcagcaaaggaaaaatcaaggcttggaagacagaaatatcattctcccatatacctgcaaaa

SEQ ID NO: 94194 - DNA, 159 bp, Homo sapiens
cttctccccaaaattcacctcattttaaaaggcactgtaaattgttttataaagcaaatacatacaaatagtcttgtactttgttttaaaagtttttggttttcatttttttttttttttttttgagacggagtctcaccgtgtcacccaggctggagt

SEQ ID NO: 94195 - DNA, 647 bp, Homo sapiens
agataggacgcagcaactcacagagcaaccaggacccagaaatcgcttaagagaccgcggcaaagtaacttaactgagttgccttcttccatattttcacgcccctttcatccagaacattttttttcttgaactgcttccatggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacctcagtcggacaggaccacgagtgtgattcctgaagctgggacaccttatcctgatcctttggaacaatcatctgataaaagagaatcaactcctcatcacacaagccagtcagaaggaaacacctttcaacagtctcagcaacccaaaccccacctgtgtggacgaagggacgtgagctataa

SEQ ID NO: 94196 - DNA, 650 bp, Homo sapiens
tatttcttttccaccagttatacagatatattaaattcatcatcattgactttgactttcttttcttttcttttttaccccaagtttacaacctccacctgccaggctcaagtgatcctcccacctcagcctccttagtggctgggaatataggcatacaccaccacacctggctaattttttgtatttttggtagagatggggtcttgccatattgcccaggctggtctcgaacttctggactcaagcaatctgcccgcctcgtcctcccaaagtgctgggattaaaggcgtgaaccacctcacccagctgactttgactttcaaaaccaactaactaaattaccaaggtttaatattatattccccttataaaagagaacttttatattacataccagttactagcttataattctttcctctaactacttttttcttttagaagcctattaaggcttattttttactgtttttaaaaggcttggaagatgttaaggattttttagcactttctgcataaattgtttactagactcttcaggttttaaagatcatttcactactgaaaccagatacaagtgcttgcataagaaaataatcactttttattaccaaagtaatacatacttgttttagaaaggttaggaa

SEQ ID NO: 94197 - DNA, 577 bp, Homo sapiens
gaatattaatatttcaacatgtaaacaatattttttaaaaaatcaatgagatttaactttttgtgaaccaagcctttgaaatctggtatttcacaataataatacatctccatttggactatccacatttcaagtgctcgacagccacaagtggataatgcaggcctagagagaatgtaagcatagaagtcacttggtcacaggctagaaaaatcttcaagcactgaaacaatccattgagcgaaacaaagaggaagtgagaaaaactggaaactaaagtttactgtgccaggcatttgacatttattctcatttattcctcatcacagtccttggacacagtgtttataggtgaagaaatgaaacacaagtcactgaagcaaagttatcagcttataactggaaaagccattacttactgacaggaagtaacagtcttcaaaactgttgagaacatttagatcatcttaggagaggccaaacagggagataaaacaaaacaaaaacaccccagccctgccacttttaatttaaaaacaaaaccaaaagtacagatatgaaaggcaaaaaaaaaaaa

SEQ ID NO: 94198 - DNA, 428 bp, Homo sapiens
tgagcacccctttggctaccagtaacagaaaagccaattcaaactggcctaagcgacgatgggtcttttcctctcacagaatgaaaggcacagggatgggcacctccaagtatagactgtcagagctccgcttctccgtcattttcttggctgtgccttacttggcattggtgtcatccccaggctggtaccagattgctgccacattgctagatgtgatcaggtcaggggaggaagagaggtgtccttccttgtatgtctatgtctccctgtgaagaaagttttctgagaagcctgcagagagttactcctcatattcccgcagccagaatcttgtcaaatgtccctgcctaacccaatctttggcaaggagaaatgcaacaccatgatcagcttagatgaaccaggatgaactcacagaaatgtgg

SEQ ID NO: 94199 - DNA, 809 bp, Homo sapiens
ataggtgcaaaagtcctcaacaaaccactaacaagttgaattcatcagcacattaaaaatatcattcactatgatcaagtagggtttatccgaggaataaaagaatggaataatatacgaaaatctttaaatataatcaaacacattagcagaatgatgaagagaaactataagataatctcaacagaagcagaaaaagcatttgacaaaactggacatcattttatgatacaaactcttgattaatttggcaaagaagaaatatacctgagcacgataaaggctatatatgatgatggggtttggctgtgtccccacacaaatctcatcatgaattgtagtctccatgatccccacatgtcataggagggacccagtaggagataactgaatcataatggaggcggttacccccatgctaatctcgtgatagtgagtgagttctcacaaaatctaatgattttataggggctttccccaccttgtttggcatttctctttcctgtcaccatgtgacgaaggatacatttgcttccccttcagccagaattataagttttctgaggcctccccagccctgcagaactgttagtcaattaaacttctttcatgtataaattacccagtctcaggcagttatttatcacagcatgagaatggactaatacatatgagaaacctacagcttatgttatactcaacaggaaaatgttgaaagttttcctctgagatcagtacataaagagagaatgtccactctcaccacttctatttaacatattactgaaagtactagccagagaaattac

SEQ ID NO: 94200 - DNA, 393 bp, Homo sapiens
atttgtcactagattccagcctctcaaattactgacacgcatcctttttatgtaaagatgacattgttctttcctgatatattgcattcctcatgaatttcttatagtcatagaatttttataaaccatttcagaatcgctgaaataaacatcaatatttttaactttttcattctgtcaaaaatattgtatgcagagatattgctgtaagtgtgtatacctgtgcttaagagactagggctgaagagaagtaatcaaccgaaccactggtgtaaatgtgcgtcacatttttagtgactagaaattgaaataattccaacaaatttatgtgctttgggcttgagaattcagactgccttaggctaagataaaaatcttttcctggtactatat

SEQ ID NO: 94201 - DNA, 419 bp, Homo sapiens
aaaaatgatgagaaaaacactccaacaattaagagagtgttataaaatctaaggaacaaggaactaacaaagttctaatgatgtggtaaaaataagaaagatagctttaactattagattatccatcaataactttggaaaaacagtttcggtggaatactatgggtagaatacaaatttctgtgggtagtgtagtggatagaattgggagttgaagacatggagatgcagtattgatagttgtgtccctgagagcacgtagcctggacgctggatgtcctggatcctcagcttgccactggccatggccaatgttgtagtgagatatattaaaaagcagccaaatggttacgcattattattggctaaaacttttaccccaaactccaatgtattcatctactgaaataaaccaaatt

SEQ ID NO: 94202 - DNA, 312 bp, Homo sapiens
caaaaccacatctctactaaaagtacaacaattagctgggcctggtggcgggcgtctgtaatcccagctacttgggaggctgaggcatgaaaattgcttgaacccgggaggtggaggttgcagtgagcccagatcatgtcattgcactctagcctgggtgacaagagtgaaactccatctcaaataaaactgaattattttaaaaaataataatttatttgaccttcagtttcttcatttgtagaatgggcatcatagtatggtatctctatctgcttctgaaggttatcatgaagactaaataggatattt

SEQ ID NO: 94203 - DNA, 486 bp, Homo sapiens
cttttcaaattgaatacatgataatttgtgaaactagttttatgtacatttagacaaatacaatatgacatagcacagctaattccccattttgacatattaaaatcataccctaccaccaacacccagcactgatgtcagccctctattaagctttctggatcattctaatcagaagattttcgtcttgttctaatttctagcaattgatgcatatgtaattcatgatgctattaatattatttccatgtgttttttccacctattaaattgtaataaccttgaaaacaagaataattttattcagctccaacaatattctgattgtactagcaggttaataatatttattgattaaatgcctttgtagtgagagtaattgttagcaaatagctaactccaacccttccaaaataaagatatacattcaggtagagaatataaacttggtgaatgtaggtcattcatttggtacagagacatcaa

SEQ ID NO: 94204 - DNA, 482 bp, Homo sapiens
cagagacccaacaggaagtgtggagaagtaggcttggtaaaggatggaaactgggaagccctgggcttccaggtggacagaactcacagtctcattagtgtgctgctgctgcaatggaaaattccagcaggtttctccatctaagagtcaaagtcctggtaacaagggttggattggcttagcttaggccacatcccacaccttggccagggggagctgggacaccctgagtgacagtctcgccaagactacacacagaggggagaagtaattttcaaataagaaatctagaaagaagggaaagtggatatgggatggacaaaaatgattggtgtctgtgactgaaactcatgacatgtcagggtagccacctggctcatcaactgtcatttcatcattcagctggtagggcttcctgacacctttgggggaattgttgaaattgaaatgtaacacgcaagtatcattcattcctccttctt

SEQ ID NO: 94205 - DNA, 294 bp, Homo sapiens
aaccccttgttctaatgctctaacctttactggtaaaatacatgtaatatgatatgaaacaagactttgattattttcaaaactgttaataccagacatggagtgagaatagcattataattctgacgactgttgagaaaacacagcaactattttagaatcaaaaaaatgaacctttttctttggaaaattttttaaaatttggaatccccttggaatgtgtcagtatatttgtgtcagaatgcatgttttaatttttgaattgccctgcaaagttaattgtcagtttaacag

SEQ ID NO: 94206 - DNA, 472 bp, Homo sapiens
gcagtattacctgaggtcaggagctcaagaccagcctgaccaacgtggagaaacgccgtctctacaaaaaatgaaaaaaattaggcatgatggctcctgcctatagttcctgctactctggaggctgaggtggaaggatcgcttgagcccgagaggtcaaggcttcagtgagccatggttataccactgcattccagcctgggcaatagagtgagattctttcttaaaaaaaaaaagtcaatttaggagagaattctttctgaaatcattgctgggtgcttttatggattcccaaaccctggggatcctgaaggctggaaactacagaatcagttcttgctgactgttgccaacatggacctgacacccacacttgagtttttaggatccccaatccccacacttgagttttagaggatcccccaagtcctgagaggagaactactcccctacatgcctccagaggaaagag

SEQ ID NO: 94207 - DNA, 788 bp, Homo sapiens
gattttattggtagagtgggaatgtattaaaattctctacttccttgttacatggtctttcctccaccctacaaggtgtgtgcttgtaactcaaatttccatttgagtaattagcaattattatttaaaactaacctgaaaataaaaattgtattcaattcattcatagggagcatctacctatttattattaccacataggtgatgtgactctagaaacatcttggtattcaaatagccaattaaaatataaaatgtaatgattttctaaagctactcgttttccttctctcatctctatctactaattggaaagtctattctccaaacacagcaaagatgattgacagaattctaaaaatacacaaatttccctattaaagagggtgaatggatgttagcactgtatcagacacataatattaaggagatacctgctgtttaacattaacattctgtgtagtttttgttttgcatcaaacagacatcaaaaagtgaataaaaacatgtcgtgaaattaccaaataataaattaacttcctggatacaaggaagttattttagcaagttctttttaataaaagcaaagaatggggatgtaacaattagagaaatgtggaggaaaacataagaaagttgggagagggaggtcaaatctcacttccagttatcagtaaagtgcacattcttttctgtattctgtgaggctggaggtgctgctgatagaatgtcctcacatattctgtcaatgccaggatgcaaacatcactaaataaaccctcgtgtca

SEQ ID NO: 94208 - DNA, 333 bp, Homo sapiens
aattaatagttgtgagaaagtcccattattgtattgtgtaaatttgtagtcatacagtcatatacaaataatattaaaattcatacatagttataatgctgctgtccctagagagctggcatgtctcctcaatagtggtaatagcacatttttctaccctaccaacttcctcccatcctcacaccccttttaatttgtagttattaacattttattctagatttattgttcataccaccacagattatcagcccttgagttcgtcttcctgtaaggtcatctagtgacttatattctttaattacttggattatttaactttttttctcctta

SEQ ID NO: 94209 - DNA, 1215 bp, Homo sapiens
gtcaggagaatcgcttgaacctgggaggcggaggttgcagtgaaccaagatcacgccactgccttccagcttgggtaacagagcgagactcagcctcaacaaaaaagaagtgttaaaaagttttacttttaaatatttcttttgaagaatgttctgtgtgaagttctgaaaaaattctttcgtgctgtttttgggagatgcgttgtgcatatgtaggttaggtccaatttaacgtatagtttaggttgcctatttacttactttttttctgtctgtcctatttataaaagtggtccgttgaagtcttttattattactgtggaacttttctccctttagttatgtttctcttgcttcatatattaaggatctctaatattaggtgcatatataactataattggtatatcttctagtgaattaaccctttaattattagataatgctcttctttgtctcttgtaccagttttgacataaagtctgttttgactgataccagtttagccacctccgatgtctttctattaccatttataagggatatcttttttcaccctttcaattcagcctgcgtgtgtccttcaaataaaaatgaatcttttgtggatagtatgtagttggagcctgtttttaaaattcattcagccagtctctatcttctgattgtggagtttaagccacttacacttaatgtaattactgatagagaaggactcactcttgctgttttgctgaatgtttcctatatctcttagatttttttgttcttcatatccgttactgcctttgtgtttatttagttgattcttttgtcttgacatacttttatttccattgtgtgtgtcttctatacattctttgtggttaccattgcaattacagaaaacactttagatttataacatcctgttttaaactggtaacagtttgacttcagtcacatagaaaaatgactcctttacaggtctgctcccatgttatgtttttgatatcccagattacttccatatatactgtgtctccatgaacgtgtatttaaaccttgacaacaatttcctgctttcttagttttttcagattaatatttgcccattttgccagcgtgtcttcttctgcatcccaagtctccttaacattgttgtactatcaataaggttttatgttgtctttttgtgtgtgtacaaaataaattcatccatctcctcttcatggc

SEQ ID NO: 94210 - DNA, 1650 bp, Homo sapiens
atgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatattttgttgactttaaaaatgaaatcattcacaaacttttggtatatgatggagaatgagaatacatttttttactgccttaacctgtagtgcgtagaatatgcatcagtttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaacggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggat

SEQ ID NO: 94211 - DNA, 579 bp, Homo sapiens
ttttcctattttggagtttttgggttttttaagcctagggaatgcctaatatgtactgtggagtgcatttgttcatttatatcccagtgcattgtaaaatcgagcaattcagtgccttagaatcctttctgtgaacttgatgctacgtgaactacttgagaacaactactttcaagccctccgaagcactcagttacaactgtcggtctaattgcacattattctaattcattaaaaaagtccccaagggcttcttaggatactgctctatgttattagaagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattacttt

SEQ ID NO: 94212 - DNA, 918 bp, Homo sapiens
caaacaaacataaaccaaagcaaagacacttaagggctgggtactcatgcctgtaaacccaacactttgggagtttgaggcaggaggctcatttgaggccaggagtttgagaccagcctggggaacatagtgagaccctgttgcaacaaaaaccagaaaaacaacaaaaagaagacattggaaaatggctggagctgattctaggtgaataaacaaccctcgacttaacttgctttgcctctgggatatgtttatcgagcgtcttgaacgttgaggaagccagccaagagaaagagcctgatgccaaggtcacaccggtccctgctgctcatggggaagagaaggcccccaactagatgtcccagaactggccgctccccacttacttgctggttcacaccttctttggttttagcgcacagggcatttcttgggctctggagtaaccactgaggccagagtgagagtccctcttccctggagggagaggcctttggggatccagacaggcttctctcctgagggaagacgctggcctggggtcactcattttcacggggagggtgtgctggcgggatgggtggaagggcctggggccccggcagcccattgcggaggttttctcgggagatggtgggtatgggactaagggtgaaagggaagttgtgagttgggtaagaaaggcctgaggatctggcaggggaaggcggcacacctgggtgtgtctcccagaggaaggcctgtggagccctggcttcaggagacagaagagaggattaacggtagaagctctttcatgttagaaaataaaacaatatagctaagggattatttggttgtaaaatccaacaccattaataaaactgttatattctgaaaaaatcctcattaaatccacatgaaaagacatgtgaccta

SEQ ID NO: 94213 - DNA, 683 bp, Homo sapiens
caaacaaacataaaccaaagcaaagacacttaagggctgggtactcatgcctgtaaacccaacactttgggagtttgaggcaggaggctcatttgaggccaggagtttgagaccagcctggggaacatagtgagaccctgttgcaacaaaaaccagaaaaacaacaaaaagaagacattggaaaatggctggagctgattctaggtgaataaacaaccctcgacttaacttgctttgcctctgggatatgtttatcgagcgtcttgaacgttgaggaagccagccaagagaaagagcctgatgccaaggtcacaccggtccctgctgctcatggggaagagaaggcccccaactagatgtcccagaactggccgctccccacttacttgctggttcacaccttctttggttttagcgcacaggggaagttgtgagttgggtaagaaaggcctgaggatctggcaggggaaggcggcacacctgggtgtgtctcccagaggaaggcctgtggagccctggcttcaggagacagaagagaggattaacggtagaagctctttcatgttagaaaataaaacaatatagctaagggattatttggttgtaaaatccaacaccattaataaaactgttatattctgaaaaaatcctcattaaatccacatgaaaagacatgtgaccta

SEQ ID NO: 94214 - DNA, 361 bp, Homo sapiens
ccctataccatggggacatcacgttccctgccctcagtttccccatctctaaaagctgggcaatgaattaggtggtctctaggatctgctcctgacctgacagtcgttgcttctaagacaacagcagaaagtgcctacaattcacgcaggagagctacgcagcagcgcttcccatactctgcagcagaggacctctacttccataaaacacaacaaaaacgaagtactaggagaaggaagtgccgcacagtgccacctgcggtgatggcctctacacgctggctctggttcctggatggttctcatccccgaccatggcacaccattaatggactgtgcagaccatgtggaatgacaccgc

SEQ ID NO: 94215 - DNA, 624 bp, Homo sapiens
atagtgtctgttccttcccagctggcagagtgggtaaccaggtgtctgtagctgagaccagggacttacaggctctataaaggataatatagggtaaccgagaataaagtctggggcttctccaagaagccgatatgggtagtagacagaacccttggaagccagactgagctgggttcaactctccaaggctggggctgcttcccaaagctgttattatgaagtggaatggaccttagaagccaggcagccgtgggttcagatctcagattggctacttgtcagctggtgcctaacctttgaacccttagtcttgtgtgcaaaatagagactctgccgccgccccaaaacagatgaaaattagatggaacctgtgtgcaagtacctgagctaatttaaaagttaacatatagtaagtgcttaaattaggatccatgccaggcatggtggctcatgcctgtaatcccagcactttgggaggctgaagtgggaagatcgcttgagcccaggagtttgagaccagccttggcaacacagtgagacctcatctctatttaaaaaaaaaaaaaaaaaaggccaggcacggtggctcaaacgcccataatcccagcatattgggaggcc

SEQ ID NO: 94216 - DNA, 376 bp, Homo sapiens
cctgggaggctgaggttgcagtgagccgagatcaggccactgaactccagcctgggtgacagaacaagactccatctcaaaaaaaaaaaaaaagttaaaaataaaaagaaataagtgaaattaatttcagtaatatcgactttatttatgtaaaatattgttaattcaacatattattgattttaaaatgttaacgcaacattttacgttttttttgtaccaagactttgaaacctggtgtgtatcttaggcttacaacacatttcagttcaaacataaaattttcattggaaatacttgatttgcttttagatttcataaaacttactactttttcatggaaaagtaggttcacatacccacgtttttccaaaca

SEQ ID NO: 94217 - DNA, 552 bp, Homo sapiens
tcatagctgactcttgaggataaacccgcggcgagttcatgcacgaaactgacagtcttcagggctcggccgctgctttctggatgcataaagctcaccaccgcgatgaagagaatgttctcgaacagtgcatttccccaggggcccgtggtcaccctgtgctggatgaggctgctggcccgcacacggcaggggtggttccgcagtgctgggagctgcctgccctcgggggtatctggcccagagtccctgcttctgggtggggctgtgcagagggtttgaggaagcttggagtcctaccagggtgggctccacctggaccccccagaggccctcccttgggcctccagctggcaatatatgagaagttagatagggcgaggtggaggcacgttggggcagggcctgagctgccagggacccgccgtgggagggtctcagggaccctcacctggcagcatgaggaggcgtcagtagatagcaggtcccgtgtgtatggccagagtggccggtctgcctgtgtgaatgcctgcaggacaggagcccgttcac

SEQ ID NO: 94218 - DNA, 572 bp, Homo sapiens
attctgaattctttttttaagtaccatcctattcaaccttttgaaatgaaggatttgccttttagtgggaaatctgcatttcaacacaaagatggaacacaatgtctttggcttagttgcttttcagaaaagcaagattttttttttttggaattatatgctttgcttatgttaaagacacagcttgcagaaaaattttgtttaggcctgacagattggtggctggcatttttatagataaaggggcacgcaaaatgtcatctctacttcctccctttattgagaaaaagcctaggaggagaactcttaaaaggtgaagttagtaacctgttgtttgagtaatcaaggctctaagaggatagcattgatcaaaaaagagttttaaaatgagtgattgatgttattaaagtcactggtgaagtatcaaggaatctaaggaccatgagagagtttcagggaagaaattctatattgtagtgtctataattattgctttcttttgtttttgcagaatacactttttaaagaacatcaggatttggtaaaacagccagtaaaaaagcaatgaagga

SEQ ID NO: 94219 - DNA, 208 bp, Homo sapiens
tgtttgaatggtatatttaaatttaccttggtcattctcacaaaaaaacaactttcttaattgggactaaatagatggcatccaatggataaactgtcctcatgttttcaaaccaggacagctcctaaagtcatagacgtatatttacaaaatgacatttggcaggccattgttattttagttgctttctgaattaattcataggatc

SEQ ID NO: 94220 - DNA, 145 bp, Homo sapiens
ctcccaccttgccatcagggccaccttcttctagtgcattttgaatgaaagggggtcatcttacacccactcctgaggtgaagtggcctgtgctccagcctttcctccatgaccgcctcttcttagtgaccactcacagctcctg

SEQ ID NO: 94221 - DNA, 1195 bp, Homo sapiens
tcccactgccaaaaaatgaaagctgggaatagcctaaatttccaacttagttgaattgttcaatatattagagttcatcaatatgagagaatattatgcatctaataattgtgacgactatgtataaacatggaaaatatttaagatctgatgtttaactagcatatacactattattgtagctatgagaaagaaatactgcatatttagaaattaatatacaaaaatgaaaacaactatgtttggggacagtgattatgtacttttaaattttttttaatcttgttatctttaaacttttctaaaaatgatgtgattacaagcaatggctctttgggatcacctaataaatacctactaaattctagacgggacaacgagctctgccatcctgcaatggctcctgtgacctagttccagggccattctgaatggacagaggtcttcacaatggaggtggagatgcagggagctctatggcatgaaatggttaatgattctcttttgtaattgtgttttctgtttgctgccttagttctaaaaggaggcaaaacaactgtggtttattctaccttttccaggcatagttcttctcctacctttgtgatccccaaattaatatcaaatgtctaattagtttttttctccattggtgatccccaaattaatatcaaatgtcagacaaagtaaatcaaagtacaaataaaggtaaaactgctcttgcaaagggctaaaatagcaatgtttactagaagcattcaagagccagttcaatttcctatttctcattaagtggtaaaatagtaatgccaagaccacatcccagaatctccagggtaacagaggcccaacgaagggctgcagagaaacttgaaagtaaactggcttagttctttacacacagaaattgttctacaaagatctcttgcaaagcagtgtcaccagtagcatcactgccactaagccaatgtcccaggaattgaggaaaggaagacacccttaaagaaaaaaatggaaaaaagccacaaggactggtaccacagtaaatgtctgcctgggtctccctaaactgtcttaggtgagcttacccaggaatgtttctcccctacatgtttgccttcctttgtttaagcctttattcctcctaaatgaaaataaatacccccgactggggaacatggagtttggagtgtgt

SEQ ID NO: 94222 - DNA, 1141 bp, Homo sapiens
tcccactgccaaaaaatgaaagctgggaatagcctaaatttccaacttagttgaattgttcaatatattagagttcatcaatatgagagaatattatgcatctaataattgtgacgactatgtataaacatggaaaatatttaagatctgatgtttaactagcatatacactattattgtagctatgagaaagaaatactgcatatttagaaattaatatacaaaaatgaaaacaactatgtttggggacagtgattatgtacttttaaattttttttaatcttgttatctttaaacttttctaaaaatgatgtgattacaagcaatggctctttgggatcacctaataaatacctactaaattctagacgggacaacgagctctgccatcctgcaatggctcctgtgacctagttccagggccattctgaatggacagaggtcttcacaatggaggtggagatgcagggagctctatggcatgaaatggttaatgattctcttttgtaattgtgttttctgtttgctgccttagttctaaaaggaggcaaaacaactgtggtttattctaccttttccaggcatagttcttctcctacctttgtgatccccaaattaatatcaaatgtctaattagtttttttctccattggtgatccccaaattaatatcaaatgtcagacaaagtaaatcaaagtacaaataaaggtaaaactgctcttgcaaagggctaaaatagcaatgtttactagaagcattcaagagccagttcaatttcctatttctcattaagtggtagaagggctgcagagaaacttgaaagtaaactggcttagttctttacacacagaaattgttctacaaagatctcttgcaaagcagtgtcaccagtagcatcactgccactaagccaatgtcccaggaattgaggaaaggaagacacccttaaagaaaaaaatggaaaaaagccacaaggactggtaccacagtaaatgtctgcctgggtctccctaaactgtcttaggtgagcttacccaggaatgtttctcccctacatgtttgccttcctttgtttaagcctttattcctcctaaatgaaaataaatacccccgactggggaacatggagtttggagtgtgt

SEQ ID NO: 94223 - DNA, 391 bp, Homo sapiens
taaaaaatgctataacaaatatatgaaaatgtagcctaagaaatgttgttttaggcattgactacaaatttttaacttttgagtttagaatccttgtttggactgtgcaaggctatgatgtctgaaattttcccaccaaggtattgtattgtattgtatgccatacaataccttgctgaatgaattcattatcaaattttaacaccttcataaaaggcctaaacatagccttttatgaagactcataagcacagaatgggcaaattcatgttcttgtatttatttggtgaatataagcttgtttttcaaaattatcctattgttattaccttggtcactcattttccagatcactagagtcagattagcatgtttctgaatgcataaatgt

SEQ ID NO: 94224 - DNA, 269 bp, Homo sapiens
ttattctaacctccctttttccttatttgtaacctcctactccaacagagagaaatctgtctcctaccatctgccatccttttatatatttgttcaattttagtataaatttgtagtggctttagaatgatactccatatccattgaaatggcctttaacaactcaagtacggcgctatacattgttactattcctttagtcttatattctccattgtcaaattgattttaaaatttacactgacattcacaggacctagaacagaaat

SEQ ID NO: 94225 - DNA, 343 bp, Homo sapiens
atgaagaaattaagatggaaataaaaaaaatttcttgaaacaaaaaaaaattgaaatacaatataccaaagcctgtgggatacagcaaaagcagtgctaagagggaagtttatagcaataaacacctacatcaaaaaagtagaaagatttcaaataaacaatctaataatgcacctgaaggaattggaaaaccaagcccaaaattagtagaagaaaagaagtaataaaaatcagaccagaactaaacgaaatagaaactaaaaaaacaatacaaagggtcagcaaaaaaacagattcttcaaaaaaataaaccaaattgataaaccagtagctagactaacca

SEQ ID NO: 94226 - DNA, 419 bp, Homo sapiens
aggagcctaacagctttctaaaaatctacccttgaagtttgttcctaaggtggggagaagacaatatatttgtgtttattgtaacagatttttagtggaaaagaatagggtcctagagagaatgagggggacctaatttagatggtggtgggagtgtcagaagaaacctcactggggaagtaacattagtgaaacttaaaggaggaagtaggacatagcctggcagagactgaggactagcttctaggactgggtagctaggcgaacacaacattttaggcaaaggcactaactgaggaagaatgggtctcagtgggtttggggatccgatggaaggcccctgtaactggaaaaataggaagcaagtaggtagaataggtaatgctacagtgttggagaggccagggaactgctcatga

SEQ ID NO: 94227 - DNA, 651 bp, Homo sapiens
cactactcttcacaaagaaagaacagacttttaagtgtagtccagatggtgatggatgaacatgatatttctttgtcctttcccaagacagggtaattgtgcatcatgcatggcagtccgtggtcatttttaatatttaagtgatgtctgagttggagattaaaatttataaagagcagtgagatcccagagaaaaggatgggaggccactttcctttcaaatgttataaaagcagatgggcctcccattccagacttatgcattaaaacatttaagattctttgtgatattggaagcctacagaaagaacacacgttctctctctctctctcgctctcacacacacacacacacacactcacacacacattttgcattaattgatcatgaaggtaatttcagagggcaaaattaatttttgtttttaaaaacctataatgtaaccttaggacctagcatgttgactaaacaaataatgatggagaaacacagtaacaatcttaaatggagggaaataatgataactaccatgataatcattaccttgaaatattctcagacactttacaaacatgatctaattattcctgtgtacatctctcacgggaaaggtgttatttccatcttgaagacaaatataatgtctactc

SEQ ID NO: 94228 - DNA, 834 bp, Homo sapiens
gttacaagtacatagcagatgttcagtaaatacttgtttaataaatagatttgaatgcacgatttttaaaggatacaaaggtaactgccaagaagtcaatattttgtcttgttctgcccccaaacctgattaccttttttttttcatatttgtttacatcatgtattctaaatttttgaacatggcttttaggaaaatgtactgaatagctcttattctgacaagattggctataaagtagtctacctaatcagcacttctgtggctaaacttgtggtataaaaaccaaccaaccaacaaaactgctatccaagtcagcttgttttaaaccagtgtgcacatggtgtatcatacataactggggagatatgtggtacttggttatttcaaatctggccagtgctctgggagaaagctgctataaagacaactaaagtttctagtgtttgtcagcctggaagtcctggtgattgcccttggggcaatgtggggacaacaatcatggaattctaagtcagacttaaaatcagatccctgatctgcccctcattatttgagatcttgaagaaattattctttctaatggttaattttatgttgcaatttgacagggctacaaggtgcccagatatttgttcagacattcttctgggtgtttctgtgagtggttttggatgagattaacatttaaatcagtagacaaagtaaagcagattaccgtccctaacatgggtgggcctcattcaatcctttaaaggcttcaataaagcaaaaatgttgtccttctccaggaagagagaattcttcctgcttgactactttgaactgaaataa

SEQ ID NO: 94229 - DNA, 674 bp, Homo sapiens
aagcatcatttgggggcatgtaggtggaggagcgaataagagaagaaggagggatggctggagaggaggccgaggccctggacagttggggtggagcagctcctacttcgctggccaggcgtcgctgttcagccagtacatctcatcagctccgtgcaggctgcactcaggaagacacctttgagcagttccttctgaacggtggtcctcgggctgaaggctggcctgcacctctgtgcccagaatcagttgctctctggtgctcttttctcaggtgtcttatggagcatagcccaggcccatgcagggttaggtttctcccagccttactccctgcctttccacaccgcgtctgtgtcgggggcgatgtgctccagctcctgcgcctgctccctctggcgtccgcggcctctccccttgggtggctggagatccagatgaatgagctgctcctcacccagacgttcgagggcttttgtgcaagcaccaccattcagcttgctgatctttaatactgagccgccagttgctttcccgccccctggcaagctgagccctgagacagagaaggatgagtaatgaggagtaatatcttccttttgatttgtggatggccctgtcactcaggcaacaaaggctggcattgttgctgtagataacagactctccctcat

SEQ ID NO: 94230 - DNA, 414 bp, Homo sapiens
attgaatcacttacctgcttacttcccttttttggcccctcattgccctcagaatagcatccaactcctctaacttgatccagccttaaatgacttctccatccttaattctggcccactctctctcatctattctaagcttcaaccaaactgaactacttagagttgctgaacatgaatacatttcattttcggttgcttctaacttctggcaaagagagaatacttgtttggaataatattccctattccacactccctgacccctgcttgtttttcaggtatgagctagaatgtcacctctggtaaacctttcatgggatacgcagtattaggccagtaaaaccacgtttacttaccccatttgatcactttagtacacagtactgtgttattgtcactgtcaccaatgtc

SEQ ID NO: 94231 - DNA, 405 bp, Homo sapiens
cgaactagtcacttctaaaggcttcatgttttccctccaaaaagcctctgatcccccttttcccatggcacttccagtggtgaagtgtttgggttttgaggactgttgtcctcatacattttcaggagcagccaggtgttgaaatacgtgggtcctaactttgctcatgaatggtgtgtagcacagaggtggtcagaaacacggggaaagtgaggaagttggataataccaagtgtcttaagacagttgatatctggggctatctagagctcagcctttttaggggacacttgatttcctggagggtgataaggaccctggtgatggggaataatggtccggctgttgaagtcattgatgtcaggggagcctggaatttggtgttgacacctgatttcactttcc

SEQ ID NO: 94232 - DNA, 783 bp, Homo sapiens
gtttcccttaacttagcttgttttacagtttttcttaatagtttatcataacacatttgttgtattagaatagttggatatttgtgttctgggattagggatttgatcacattcagggtgtttagggagcctgaaggttttattaaatgttcattgtgatgtgtcttaattatctgattatgattatgattcatcttacatcctttaataacctgtgtggaaggcctactctgagtctgtggcccttgtcctccgcctggcagaagctcagggtttagggctcacccctggaggccactgttgggatgaatcctggcccctccactctggccgagtgaccttggcccttcacctctttaagccttgcttccctcctcagtgagatggggatcccagtggtatcttggcccagtttagctgttaggattcagtgaggcaacccaggaggcgtgtgcagcacaaggcttggagtgagtgcccagtcgttggctgtaatgacagtggcactgcagtgtgactcttcttagggttgtggccagagtggagggcatttattgacatagggcttccgagcttcagtttttagtgtgtggcattgtagagagaacattggactagaagtctgtggatctggtttctagctttggctctgccataaacagtaaaaattatttcctaatggttgctttcacgtcaggcagtttgaaagaggtgggagacctcaagccagtggaccttctctggtgttctttttattcaccaggaatgttagagggttggaat

SEQ ID NO: 94233 - DNA, 709 bp, Homo sapiens
agcggaactgcccctggcgtcaccacgcgggccccatcaatcgccccgtcgggccgggaggagccgcaccccaggactggggcaggggccagctccgagggccgcagaagcggtcctgcaggcgcagcggcggggctaggcggcccgagtgtcaggggtggtgggtcccggagataactcggacgccaccacccggcggcctggcccaagcgtggggccgctgccctcccggctctgatctcctcccccgggcccgagggttccaggccccggccccgccctcgagctccgaatcccgggggcgtgcggggtggcgggtggcgcgtgtgggctccgcggatcctttcgagcgtggatccaacagtccgtctctttggtgttacgcggcccgtggttgtccctgcggctgaggatgtgtgtgtgtgggcccgagtgtcccgtgcgccctgtgcgccttctgagtccagttaggcgcccgcacctgttcccccagctctgtgccaggctgcgcgggggaatggctggggagataagacgcttacgtgcacatataacttaataatcacatcatgactgttttgttttttgagacagggtcttgctctgttgccctggctggagtgcagtggcacaatcaaggctcaccgcagcctccagcttctaggcttaagtgatcctcctgcctcagcctcccaaaactctgggaata

SEQ ID NO: 94234 - DNA, 398 bp, Homo sapiens
agtagtgtgtgtataaaaggagccaggcaaacatatttgttacatctaaactttagtaaaataaaagaattttgacaagcttttaggattcattttggcctatattatatcagtatatttatttgctttctgagagaaactttgcttgttttcaaatgtgagggagatcagaggaagcctccccaaaatatgtcactttggcataatgattactttgagctgaaggcaactgaggaacagaagatgcagaaaaagttctaaaagcagagtataaatttctatttttgtaaaaggcaatttctatttataaaggtatcctcctctctggtaccagaaagaggataccaactctggagacaactctcatcacctgagatgacttaaatctgagtaagtct

SEQ ID NO: 94235 - DNA, 558 bp, Homo sapiens
gttggtttgcaattctattataaatactgcatgtgtatctgggtggtttgcaattttaaatcacgagcttgaaccaagatctgaaggatgtgaaagaaaaccaggtgtatgctgggggtggaggatgatggaggaagattctatgtacaatgaacagcatgtacaaaagccttgagatttaggaagaactattcagagaaaagaaagctgaactgaggtaaagaagtgacaggaagaaacaaagatggtgaaggaaccagaactaattcatgaggaagtaggacaagtggaatgtgacgttttaagaaagaagtggggaggttaatagctcaaatgcttcaataaatataagatgaggaatgagaaaaagatattggatttgaaatacagatcactcatgactttcaaagacaaacttcctaagttgctaaaggcttacacagagaattacagaacaagtcatttgtgaagaaaggtgaatagtacatttggaacacttttccaaagacagtaacaataaaaaagaaaaagagagaacacaatgacttgatgggttgc

SEQ ID NO: 94236 - DNA, 283 bp, Homo sapiens
ggcttagcacagttgagggcatacagtaagtgctggataaatgctggcctccactaacttcggtggactagaagaatgaggaagtaaggagacgactcctcctgtctctcagaaatcagagggttgggtaggtagtcatatatttgtgggtagaaatacgcttgaaaaagcacacaggattataggtaatttcattttctactttgtatgctttggtactttcacagtgttctatagtggacttaggcagtttttttataccactgtgtgccaatagggacat

SEQ ID NO: 94237 - DNA, 325 bp, Homo sapiens
ggtaagctgcatggtattttcattacaaaatttcccaacaagaggtagttccccaggtccacaggcaaaatcggctctgcctattccctttcttcacctaagagcttttcacctatggacaaacttcttctaaactcctaaaaacataataaattagccaagaaaatgaaacttattaagcctagtgtttgtgagaaattcagagagacatcataaattgatcaaacattttttttttttttttttttgagacagagtcttgctctgtcacccagggtgaaatgtaatcacatgatctcggctcactgcagcctctgtttcctgg

SEQ ID NO: 94238 - DNA, 371 bp, Homo sapiens
tttgagacgagtcttgattgatctgtcacccaggctggagtgcagtggcactatctcggctcactgcaacctccgcctcccgggttcaagtgattctcctgcctcagcctcccgagtagctgggactacaggtgcccaccaccacgcctggctaactttttgtatttttactagagacagggtttcaccacattgctcctgaccttgtgatccgcccgcgtcggcctcccaaagtactgggattacaggcatgagccaccgtgcccggccgaccttctttatgagaaagcatctgctttgtgaatgacagagctattggtgagctgtattgcttccttatgaagacagcattcttgtgtgtcatgttagtc

SEQ ID NO: 94239 - DNA, 404 bp, Homo sapiens
attccatttaaactatgtgtagactataaattcagcattccagaacatgaaaataatttcttaagtttgtgcatattattaaaggctttggagattattgaatatacttgtgcaaaaatctttatttttctaagtataatgtattgaaaagcacacataggctttggagatacagaagtggatttgaatctcagctcttacactgactagtctgtgccctgggacaatttacatcattgtcatgagctgtatttttagtctataaaaatagaattgattattacattactgtgaggattaaatgagataatatgtaaaatgtctaacataccacctgctacctctgaaaggtctgtgcaagtgttggtctttttctctccctttctcctttttattacttttat

SEQ ID NO: 94240 - DNA, 413 bp, Homo sapiens
tatattttacataattcccacccatataactcagtccatacagttcacagttttcattccctcatagcaatgcaaaaaattttgatgagttactactactaaaactagttaagtaaaagatgattcttaagaatttccaggctgggcacggtggctcacgcctgtaatcccagcactttgggaggctgaggcaggcagctcacgaggtcaggagatcgagaccatcctgctcggtgaaaccccatctctattaaaaatacaaaaaattagccgggcctggtggcgggtgcctgtagtcccatctactcaggaggctgaggcaggagaatggcgtgaacccgggaggcggagcttgcagtaagctgagattgtgccactgcactccagcctgggcgacagagggagactccatc

SEQ ID NO: 94241 - DNA, 231 bp, Homo sapiens
ctgaggcccggtggggagtgaggtgtgcaattttatgcactaagaaaaccacagcggtgactcatgtctaatatgtgccctgcatgttgtcaagaaaggctgtggaaaagtcaggaaacaggacttggctctggttatcgcgtgtatttccccatttttcatagtaacttggaaaatgttgctacccaacattggaaaatgttactgcgcagtgttcacaggtgtcgggat

SEQ ID NO: 94242 - DNA, 203 bp, Homo sapiens
cttgcaattcatcaagggttgagctgcacattggggcttttagatgtgctgctgaggaagtgatttcctgcatttaatcatcttctgatgaatgctagagaaactgatctagagtggctcctcttggttagaactagctgaagcatactgtatatacttacttcttttaaaaatttcatataaaggaatagaaaataatactg

SEQ ID NO: 94243 - DNA, 146 bp, Homo sapiens
tcattatagccatgggtgccacttttctgtggtagaagccaggctggcctctccacacctgggaatgagtcctgtgtttcttaggagaatcctgttgataagtatcttgcaggagcacatcctgtgagtcacttctaccttctgca

SEQ ID NO: 94244 - DNA, 312 bp, Homo sapiens
gaaatattaagcatttagccaaagtcgcacagcaaaaaggtggcaaagtcaagatttgaatgcaggctgtctgacgtcagagtctgaattgtcgagatgctacgtttcctctttatgaaagacagaatttttaatatctcgtgaatttaaatattaatcctgactcattacataaaaataaaactaggctgggcacagtggttcacgcctataatcccagcactttgggaggctgaggcaggcggatcacctgaggtcacgagttcaagaccagcctggccaacatgacaaaactccgtctctactaaaaat

SEQ ID NO: 94245 - DNA, 229 bp, Homo sapiens
acattaggtgggctcgaggtgagaatatttttctactaggtgtgcacctgattaaaagtcttggggaaaagtgcaaaaaaaaaaactgcacacactcacttcctgcagggttggagggatggaattgggtgtggaaagcactttgccagcaagatgccccatctgtgcctgcagggaggtcgggggagcaggctggggaagccttcccttctcgtgaacctggaacact

SEQ ID NO: 94246 - DNA, 319 bp, Homo sapiens
cccaaagtgctgggattacaggcctgagccaccatgcccggccccaattcctgtttctatcaagagtaacaaagatcctcattaaaggcctctaagagattcatgaaggcgcggctgggtattatttaattggtattttacttgttaggaattgtttgtttgtttgttttcgagatggagtctcgctctgtcgcccaggctggagtacagtggcatgatctctgcttactgcaagctccgcctcccatgttcaagtggattctcctgcttcagcctcctgcatagctgtgattacaggtgcataccaccatacctggct

SEQ ID NO: 94247 - DNA, 529 bp, Homo sapiens
gtggtgggaaggaagcatatcattacatgtacagaagcctcccgttttcttgtcttctctcttcatggtggtttggtttgggagaaggccgctgggttattagtgcttctctcccttctctgggccatctcatctgttctgtggcttcacttgccagccacacacaatgacatctaactccatcaccaggctggctccctccctcgacatccagacccatgtatcaaagggcccagctggacagctgcccttggagactcacaggcctctcagactgaagcagtccagaactgaaatcctcacccccaccaccaacctgcttctcgtggtgggatgccttagccagccacctacccagatccctgggtgtcatccgtcgcttctgcctgtccctcacaccctctgacagatctattgatttcccctcttcacagcctctcagctcttccctctccatcttgactggtactgcctctccccgggcctccattattgctcagggcaatgccgcagcctccccactggtttc

SEQ ID NO: 94248 - DNA, 165 bp, Homo sapiens
tggttctgctgcttctctctgcctctcagctcaaagctgagtcttcaccacagcagacgactggggacagccctaaaacacagaggttttgctcatgatacgccactgaagatttacatatggagagagagctgatgaacagctgttctcgtctcctcgcctggc

SEQ ID NO: 94249 - DNA, 344 bp, Homo sapiens
tgcagcctccgcctcccaggttcaagcgattctgatgctcctgcctcagcctcctgaacagctgggattataggtgcacgccaccatgccagtgtaatttttttttttttagcagagacgggatttcaccatgttggccaggctggtctcaaactcctgaccccaaatgatccacctgccttggcctcccaaagtgctgggattacaggtgtgagtcaccgtgcccagccagcttattcctttttattgctgggtagcatttcattttatgattataccacagttaatttacccattactagtcgatgggcatttgagttattgccagcttttggctattatga

SEQ ID NO: 94250 - DNA, 310 bp, Homo sapiens
ggcttacaggacagaaaggtcccttctcacagtttgggaggtccgaagtctgaagtgaagctgtcagcagggccacaccccctctggatgctccaggggagggtcctttgcctcttccagttctggtggctccaggcattccttgctttatggtggcatcattcatctctgctccgtcttcacgtggccttctctgtgttgtcaaatctccttctctgttctcttgtaaaaacactcgtcattggatttagggcccaccccaatctagatggtctcatcttgagccttactttagttacctctgcaaaga

SEQ ID NO: 94251 - DNA, 263 bp, Homo sapiens
ctgtaggggtcaagagaaacttcccattgccttctgaaggtttgctgaaaaagaaactcacaaaaggcagattaatgggagacaaaggcatacaaattttattaacacgtacatggggagaaccacagagtgattatctaccctgcaacgggattcagaagcttatacaccatgctggcaaaacaggttagggggtcaggggagaggaattctgttgagggacagtaaaggatagggagaatgaatgggttcgggaacagaga

SEQ ID NO: 94252 - DNA, 515 bp, Homo sapiens
tcgatctacaggattatcccggtctgtgtatcattcattgttttgttctccctccttcatttatccttgcatttatttatatactgaacaccagctctgtgccaagaattgtgctgggggagtgggtgatataaagaggggacttacagtgtatccaggaatctggacagtaactaccaggcatgaggggagagaaagagaagatctctgaatactgcaaactcagaggacgggggtgtgtgaccagctggagagctcagggaagcctttcaggaggcagtgatgcagaacctgattctgaaagaatgagtagaggtcaatcaagtgaaagagaacagggttctaggcagagagaaaaaggcatgcaacgacgcagaggcctgacagcaagcattcagtgtgactcgggaggtgggcactttggagacagattagggcatgaggctgctcagctgtcatgagccagattgcaaggaactgaattctgacatccttgtagctcctgcaggaccaaa

SEQ ID NO: 94253 - DNA, 821 bp, Homo sapiens
agttctcagtgtgtttgtgctccttcagccttgatcacaggggcagcgaccctgattcaggggctggaggcctgtatgtgtagaagggatattctaactcagttattggggaagaaatgaaagtattttctaggcagtcaaaactgtgatcatttatcagggaagaggtggaatgatgcttgcttgcattctgtgtaccttcttattctattctattagggaaattttggggaatggagtaaagggtcagaagtctgtttagaaaaactaatttggggctaaccttctgatgcgtgggaaggcaatgttctgtgtttatttggtgggctctgtgtatcattcattgttttgttctccctccttcatttatccttgcatttatttatatactgaacaccagctctgtgccaagaattgtgctgggggagtgggtgatataaagaggggacttacagtgtatccaggaatctggacagtaactaccaggcatgaggggagagaaagagaagatctctgaatactgcaaactcagaggacgggggtgtgtgaccagctggagagctcagggaagcctttcaggaggcagtgatgcagaacctgattctgaaagaatgagtagaggtcaatcaagtgaaagagaacagggttctaggcagagagaaaaaggcatgcaacgacgcagaggcctgacagcaagcattcagtgtgactcgggaggtgggcactttggagacagattagggcatgaggctgctcagctgtcatgagccagattgcaaggaactgaattctgacatccttgtagctcctgcaggaccaaa

SEQ ID NO: 94254 - DNA, 556 bp, Homo sapiens
gctgacatcagcagatcagctattctggaaagatttttaaacactcagaggtttttttgtgtttgtttgttttcttttcttttcttttttagaggcagggtcttgctctgtcgcccaggctaaggtggagtggtgcaatcatagctcactacagcctcaaactcctgggctcaaacaatcctcacacctttcataccttaggcccctgagtagctgggtgggactacaggcatgcatcaccatgcttggctaatttttaattttgtataggtggggtcttgccatttgcccaggctggtgtcaaactcctcaagtaatccttctgcctcggcctcctaaagtgccagggattataggcctgagccactacacacagcccggagtttttaaaaaatactcaattaaaatgcttcatttaagtgtatgtctctaagaaaatttaataattgattaaatattgttgaatagactgaaagcacaacatccaagcacatgaattaagcaaataatgcaagcatagctcccacactccacaaatgttttctagtcattccaa

SEQ ID NO: 94255 - DNA, 154 bp, Homo sapiens
acaccacaggacaaagaaaacctgctgacaccttggtcttggactgtaccctccaggactgtaagaagatacatttgtgttatttatctttcacccagcctgtggtactttgttatggcagccccagaattctgacgtcttacaaagcttatac

SEQ ID NO: 94256 - DNA, 401 bp, Homo sapiens
tcccaggcctgcaagccctgaggcctgcatccaagtcatcctcttccaatttcctttttgaatcaccccataccctctcagggcctcagtttccccacctgaaaagtgaggggcaggtggccataaatgactcacaaggagccttcctgtgtttagattctcagaggtagacaccatgtcactagaaaagggctctgggtttcaaaagaagggacttggatagaacctgagggagagctggggagatgggagctctgtcagctcaggggatgtctctgatgggagacattccggagacagagagaaatgtctcctcctgtctccagcctgcctgaaagcggatgccaacggaaataatttaattgttaactgagacctgtgggtctgagaagcgagggcag

SEQ ID NO: 94257 - DNA, 467 bp, Homo sapiens
ttcttcttttttgagatggaggccgctctgttgtcgccaggctggagtgcagtggcgcaatcttggctcactgcaacctctgcctactgggttcaagtgattcccctgcctcagccttccgagtagctgggactacaggcacacgccacaatgccagctaatttttgtatttttagtagagacggagtttcaccatgttggccaggatggtctcgatatcttgacctcatgatccgcccgccttggcctcccaaagtgctgggattacaggtgtgagccgccgcacccggccatcacttgattttctaaagaaatctcttgctaaaaagattactgcctcttacaaaactccacttcacataaacttgcacgtttaattgaaaaatgtgtgacaacatctatcagtcttaagacaatcactcccctgcaatgtaaaaggaaaaacaaacgttcttgctcctgtcaaa

SEQ ID NO: 94258 - DNA, 672 bp, Homo sapiens
tttaattaacacaatgtttggcaaaagttggcatcctaggaagtctgttcaacaattcatttgccattttttcccccgctcttcactagtattcttcatattccatacaagtttatagtttgtatagtaagttttagaaattgtactcaggaggctgaggcagggaggatcacttgataccaggagttcaagaccagcctgggcaacacagcaagaccccatttctaaaaatgaaaaaacaacccaggcatagcagtgcacacctgtaggatcagctgctcaggaggctgaggtaggaggatcagtgagcccagaaatttaaggatgcagtgatctgtggtcgtgccactgtactccagtctgggtgacaaagggagaccttgtctcttaaaaaaaagtaacatatacggccgggcgcgatggcccacgcctgtaatcccaacactttgggaggccgaggcaggcagatcatgaggtcaggagatcaagaccatcttagccaacatggtgaaaccctgtctcagctaaaatacaaaaaattagttgggcatggtagcatgtgcctgtaatcccagctacttgggaggctgaggcaggggaatcgcttgaacctggcaggcagaggttgcggtgagctgagatcatgccacggcactccagcctagtgacaga

SEQ ID NO: 94259 - DNA, 340 bp, Homo sapiens
ggaaggtgggttaggaatgtttattttttaaatgtagtgttttctaagctatttacaaatgttaactatttaagcgtttttttttaatttaatttgatgaggtagaaattattgttgtagacgagtaaatagaaacacagaaagagtaagtaaattgcccaaagtcactcacacatatttgagtagaagtgtcaggatttgaactcaggcagtctggcttcagagtctctgctcttccatgctgtaaatacactatattgtataggtttttttaaatatgtatttattaataaggacatagagtagtgaattaaaggcatcacttggaatctcctaaatc

SEQ ID NO: 94260 - DNA, 284 bp, Homo sapiens
tacctctctggctcctgggtagggggatgagggatgagtgaagtgtctgaattttagagaacagtagattaaggggaaatgtagatattcaggaagtaaatggtattctaagaattttgctcaacgtacatggggatgagactggaaaggtggctgggtccagatgaaagattctaaacactacattaagcagtttccaccttaatatataggcagtgggaagtcatgctgcagctgtgttttatttacattcagcctggttctacaatggatctgaaataact

SEQ ID NO: 94261 - DNA, 747 bp, Homo sapiens
gttgcttccagtttggggatgctatgaagaggctctgtgcagctctcccattcgatgctgttgtgcctgtgcgtgcatttctgtgaagtgtgtccctggatgggaaattattgggtcacaggcagggacactgtcgtggacattaccaacgatgtacactcccgggagtactgtcactgagctccgggtggcccacgtcctccccgagtagtggctccacatggcggtgattcctccctcgtacaccttgactaacgtgtgtcccagctcccgatccctgtgcgcagtcttcttctctggacggtcccgcttccagtgtagggccccagtgctgtcatgcttcctatcagccaaaagctttgtggtcagggacagtggcttcaggcatggctctaggtgggcggccacacatgaaggtgggagttggtgagatggggcgctgctgggacggcggcacaaggagagcacatgacgggggcggtgacgtgcccggagccagcctcccagcactgggctctcaggtcagtgcacccctccgctgtggccagcccctccccaccctgtggctgtcgcgtgggtgaatcagccccacagagagggcccgggagtctttctgcccactgtctctgctggggtctttgggactcactccatgagctctccaagcctcacctccccaggcatcttgggtaactctgggcaggccaagtcctctctgggctcaggagtccttcatctgctctcctg

SEQ ID NO: 94262 - DNA, 555 bp, Homo sapiens
aagcaaggtgaacccattgggctgttacaccagcactttggaaggctgagacaggcagatggcttgagctcaggcgttcaagaccagcctaggcaacatggcaaaacccagtctctattaaaaatacaacaaaaaagtagccaggcttggtagtttgtgccagtggtcccaactactcaggaggctgtggtgggaggatcgcttgaacttgggaagtggaagttgcagtgaactgcactccagcctaggtgacagagcaacaccctatcacaaatgaaaaaagaaaaaaaagtaaatataaccccaggttctggagggccatggggaagtgcttgaatggtgtgagggactccttttgcaaagcacaacagggaaagtctctgagaaaataacatctgagctctaaatgatgagagaggaccacggtgtgacaacctcagggagcaaattcctagaagagggatgagcctctgcaaaggctctaagggaagaagaagcacagcatgtgagagagacagaaaaaccgtcaccgaggccagatcacagtgggtgagg

SEQ ID NO: 94263 - DNA, 918 bp, Homo sapiens
cctgtgacaaaaatcaatgtgctaatctcaaaccaaacaacagtatcaaaagcacaaaacagagataacctaagataaaatgtcctcaaactaactcagactagcttgacaggttaagaaggggggttaaagtaggggtgttgctggttctttccgttttaacccaggaagactggaacacccaagtatccaaataaatgaatgccatgagaaaaagatcacaatgtggagcttggtgtgggaaagaaaagacaaccgagagcaagatatcccaaattcaaagaaactatttcagtgttgctttatttaataaggtgctaaagttcagagatacaaatttctgcttcgtatatgctgcctaataaagcacaaacggggaaaaaaaactaaccaacataatgagactggcttttaacaccatcacaactggaaagcttgctctatttgtcttgtcagctttaataaaaggcatctctcctctggcaggatggcttctttttctcttttcctaatagtggtaagtggcatgtcaaagaagaaatcgcttcccattccaccacccacctccaggagactcttgttttttgaaccaaactttcaggaatatctccactcctgttcagcggttcatttaggacttgggcggctacctgagtaagactatcttggactagcgggatagggggaactccctcctggttctgtaaccggcggactgcttgtggggaaatcttcccatcttcatctgcgctgacattattcaagcagggaatccctctcttgcctgcatgctgaggggaggctggaggcaggcggagagggcccgcaggagatagaaaaaactggaggcgcccaccgataccctctctcctggagcccggggcgcgcaccaactcttaggctaacccctcggcctcc

SEQ ID NO: 94264 - DNA, 353 bp, Homo sapiens
agcgggttggtttaatgatccgtcttctgcagtagtgagggtgttgtgtcatcctaggacagccttttgggagaggagccaagatggccaaataggaacggctctggtctacagctcccagcgtgagcgacacagaagatgggtgatttctgcatttccatctgagactggtgaaaatatatttatggactggtgcttgggaatcactacttagaagataaaaatatgatcttcatttctaatcacttataactgttgaatatctttatttttttctatctagagcttatgtttaaatctgttttaaaagtttcaaataaaactgtagtttcctccacattgaagaaaactcc

SEQ ID NO: 94265 - DNA, 808 bp, Homo sapiens
ggcgcacaacacctgtaatcccagctactcgggaggcttaaagccaggaggcagaggttgccgtgagccgagatcgcgccactgcactacagcctgaccgacaaagcaagactcagtctcaaaaaaaaaaaaaccaaccaaccattcactaagtgcatgtaagcaaatctaccctggttgtcccaaattgggattcaaccactttagaagtcttgttagacattttttcagttgatacataatagttgtatgtacttaccgagcatgtgatattgatatgtgcatacaatatataatgatcacatcagaataactggaatatccatcacctcaaacaatgatcatttctaaaagaacattccaaagctgctcttttagctgttttgaaatatacaataaattattaattgttggaaaacttttgaaagttatctttaagctgcttttttggacaagaggtatataattgcaatacagatggatattaacttccactgtatatttcattaaagctggtaaaatttttttaaaggatctaaaattttgccatgtaaggaacttaagcatctttatgtttaattgcaaaatttttatattcccaatataaaaatttctcttcaagtatttcctgcattgccatttttagcatgtttggctattctgctatgtaacctacctagtgatactcgctggagacagtccgtctacaggcatgtctgataggcacaagttctttattcacacaaaactaacatatagagtagaatttatgggatgatgatgtcgtttgggatagaggtatggaaaa

SEQ ID NO: 94266 - DNA, 1533 bp, Homo sapiens
ggcggctagcggcgaggccccttcctgtaccttcagggatcggccaccatgtcccaccggaagttttccgcccctcggcacggacacctgggcttcctgccccataagaggagccaccggcaccggggcaaggtgaagacgtggccgcgggatgaccccagccagcccgtgcacctcacggccttcctgggctacaaggcgggcatgacccacaccctgcgggaggtgcaccggccggggctcaaaatttccaaacgggaggaggtggaggcggtgacaattgtagaaacgccgcccctagtggtggtgggcgtggtgggctacgtggccacccctcgaggtctccggagcttcaagaccatctttgcagaacacctcagtgatgagtgccggcgccgattctacaaggactggcacaagagcaagaagaaagccttcaccaaggcctgcaagaggtggcgggacacagacgggaaaaagcagctacagaaggacttcgccgccatgaagaagtactgcaaggtcattcgggtcattgtccacactcagatgaaactgctgcccttccggcagaagaaggcccacatcatggagatccagctgaacggtggcacggtggccgagaaggtggcctgggcccaggcccggctggagaagcaggtgcccgtgcacagcgtgttcagccagagtgaggtcattgatgtcattgctgtcaccaagggtcgaggcgtcaaaggggtcacaagccgctggcataccaagaagctgccgcggaagacccataagggcctgcgcaaggtggcctgcattggcgcctggcaccccgcccgcgtgggctgctccattgctcgggccgggcagaagggctatcaccaccgcacggagctcaacaagaagatcttccgcatcggcaggggcccgcacatggaggacgggaagctggtgaagaacaatgcatccaccagctacgacgtgactgccaagtccatcacaccgctgggtggcttcccccactacggggaagtgaacaacgacttcgtcatgctgaagggttgtattgctggtaccaagaagcgggtcattacgctgagaaagtccctcctggtgcatcacagtcgccaagccgtggagaatattgagctcaagttcattgacaccacctccaagttcggccatggccgcttccagacagcccaagagaagagggccttcatgggcccccaaaagaagcatctggagaaggaaacgccggagacctcgggagacttgtaggctgtgtggggtggatgaaccctgaagcgcaccgcactgtctgccccaatgtctaacaaaggccggaggcgactcttcctgcgaggtctcagagcgctgtgtaaccgcccaaggggttcaccttgcctgctgcctagacaaagccgattcattaagacaggggaattgcaatagagaaagagtaattcacacagagctggctgtgcgggagaccggagttttatgttttattattactcaaatcgatctctttgagcattt

SEQ ID NO: 94267 - DNA, 206 bp, Homo sapiens
tccgcatcggcaggggcccgcacatggaggacgggaagctggtgaagaacaatgcatccaccagctacgacgtgactgccaagtccatcacaccgctggtgaggctgggagggggcgactgccaggcccatcacaccgctgatgatggctggagtggggtcaggctggccggggggcctggtatacatgtagggggcatgccccag

SEQ ID NO: 94268 - DNA, 510 bp, Homo sapiens
tcactgcaacctccgcctcctgggttcatgtgattctcctgccttgtcctcctgagtagctgggactacaggcgtgtgccaccatgcctggctaatttttgtggttttagtacaggtggggtttcaccatgtcggccaggctggtctccaactcctgacctcaagtgatcctcctgcctcggcctcccaaagtgctgggattacaggcgtgagccacggtgcccagccacatcgagattgttttatctccaagtacaggctcttatattgctctaccatagagaagattttttttgagatcatagcacacatgctttccattgttcaaacaagacagggaatacagagtttgtttctttcatatgatcaaaaaagaatgactgtgaacgagaagttatgtcaaagatttaggcagccctacctatggagatgagcagttgcttcggaagtgccagggcgcactctggaatgggaacagctttgcagggttggtagaggaagtgtgagaat

SEQ ID NO: 94269 - DNA, 383 bp, Homo sapiens
atagatggcccacagatgggcgtgggaagcaggcagggtgttgatggcactaacatcatccaggggacttttatggcaaagaactttgcttcatccacaggctggaggtgagacacgagttcaatactgcaacgctgaaaactgacagagccagcctcccatctagggtggaactaggccaccttcctagggtgtagcgggacttgggtcaggtctccgagcatgtgcacactgcatgatcctcagtaagctataggtttgaaattgcacctagagagctggtggttgtctagagtgtggctgtctgggtgcttcacatgcaattgagttatcacttcctagagacttttgaaagttaggtaattaaacgtttttgctgggtt

SEQ ID NO: 94270 - DNA, 385 bp, Homo sapiens
tgagaaatgagaatgagcacaaatcaaatcttcccatacatgagttcaatgaccttgggcaagacacttcacctgtccactttgtgagttttcactttccccacttataaatgaaggactgatctaaattagtgcctttgaaccccagctgcctatttgaatcatctaggttgccttttaaaaatattgcttcatcccagctaaaaaaaaaattaaaacaattggactcatgaagataaagagtagaatgatggttactagaggcagagaagggtgtgtgcgctagggagaagtagggatgttaatgggtacaaaaatgcagctagatagaataaataagatctaatgtttgataatacaacggggtgactgtagtcaacaataa

SEQ ID NO: 94271 - DNA, 443 bp, Homo sapiens
cagcccttcctctttctggctgtatgaccttgggcagtaacttaacctccttgggcctcagttttctcatttgtaaaatgagggtgataataatagtgctgaggttattggattgttatacggattcaagatgtaaaaggctgagaataatgaacatcacccagtgagtagtcaaactttttcttctcataatcattattatcaagaaagatttagcttttggttcccccctttcaattggcatttatcacaattttttgtgaagtggattttagtgttatttatattatgactatgtaaatactgtttcctttcaagccaagtcatatattttggttacatttcctttcttgtacaactctttgttcttcctggagttactactcgctttgctttttttcatttgctgtttcctcttaacccatccttaattctcttaattc

SEQ ID NO: 94272 - DNA, 446 bp, Homo sapiens
tggtgggtcctaaatccaatgacaaatatctttataagagaaacacagaggagagacccagagagaaggagaaggccgcatgaagatggagcagagactggagttattcagccaagtcaaggaatgcctggagcaccagaagccggaagaggcaaggaaggatcctcccttagagcatttggaagagtgtggccctgccaacaccttgacttcaaacttctggcctccataactatgaaataaattcttgttgttttaagccaccaagtttgtggtaacttcttacagcaaccctaggaaattaacacacagagtgtcagttacctaaacattgtgagcctcagttaccttatctgaaaatggggctaaaacttagacctaccttttagggctgctttaaggagtaatagaaattatacatgggaattacatggcaccaagttgtt

SEQ ID NO: 94273 - DNA, 592 bp, Homo sapiens
gaagtctcgttcttgtcccccaggctggagtgcaatggcatgatctcagctcactgcaacctctgcctcccgggttcaagcaattctcctgtctcagcctcctgagtagctggattacagagtcttttctaaggcaccaactacttccttcaagcagcagccagagatctttgcttaatggctgagaaacacagaggagagacccagagagaaggagaaggccgcatgaagatggagcagagactggagttattcagccaagtcaaggaatgcctggagcaccagaagccggaagaggcaaggaaggatcctcccttagagcatttggaagagtgtggccctgccaacaccttgacttcaaacttctggcctccataactatgaaataaattcttgttgttttaagccaccaagtttgtggtaacttcttacagcaaccctaggaaattaacacacagagtgtcagttacctaaacattgtgagcctcagttaccttatctgaaaatggggctaaaacttagacctaccttttagggctgctttaaggagtaatagaaattatacatgggaattacatggcaccaagttgtt

SEQ ID NO: 94274 - DNA, 813 bp, Homo sapiens
agaactcctgacttcaggtgatccacccaccttggcctcccaagcgtggggattacaggtatgagccaccacgcccggtcatcaaagataatgtttttaatgatcaggagcactttgagatgtttagaacaatctgaaacctgatttccaagccatctcaaaatatactttggtaatcaagacagggaaatgatggtgttatatcatttgtgggactcaactgattttgttgagtattggttttgctgtgggattccttgttctcttggttgtgttgggcctactgctttttaaaaaagtattttgagacagggtcttactctgttgctcaggctggagtgtagtggcgcagtctcttgtctctgcaacctcaatctcctgggctcaagggatcctcccacctcagcctcccaagtagctgggaccacaggtacccaccatcacacctggctaatttttgtattttttgtagacatgggggtcactgtcttgcccaggcaggtcttgaactcctaagctcaaacaaccgtcctgccttgccctcccaaattgctggaattacaggtgtgagccagtgcgcctggccttcttttttttttttaaccactattttttagaactagatttggcctggaaagagaaaaaagatattcctcgacttgatctatatattttatggttcattcatttgctttagaggtagaaggagcaggaaaaagtacaacaaaacaaaatcttccctttggtgtttaatttgaatgcccacagatgcttttgcatttattagtagtgagttttcataattatcaaata

SEQ ID NO: 94275 - DNA, 292 bp, Homo sapiens
aatgcttagtcttcagtaattgccaaaacaaatattattttacattatgcatttgacagaataaacattatagttgaagaatttttggttgttttatttaatatgctgattacttaatcctataatcctaaatgtcacaaattagttttatgaaaaaacacttttttatctttgctcattttgtattcaaaataattttatatctcaaaaaagtaatattctcatgagttactcatttcaataaatatttattttctaagtattttgcaggatggtatggaaaacctcaacg

SEQ ID NO: 94276 - DNA, 264 bp, Homo sapiens
ctagtttcattctctcctttattgactgctgtttctgctacatgaccaaaagtagttttcattgttcatgtttggtttgttttgcttgtaggtaaagcttattataattaaatacatagagccaaggaagggaaaaattaacagttacataagagaataaggagaaagtaagaatgaaggtcaatatatactccaaacattgatgtttctgtctccttcacatacagatattggcctcgtgttgtagccttaaaccatctgatc

SEQ ID NO: 94277 - DNA, 416 bp, Homo sapiens
ttaatttttatttcttgagatggagtcacgcacttgttgcccaggctgggatgcaatggctcattgcaacctccacctcccaggttcaagcaattctcctgcttcagcctccaaaggagctgggatcacaggcgtgcatcaccacagccggctaatttttgtatttttggtaaagatggggtttcaccatgttggccaggctggtctcaaactcctgacctcaagtgatctgcctgcctcagcctcccaaagtgctgggattactggggtaagccaccatgcctggcctatgatttgttcttgaaacatcttccccacagtttttgtttggaaaactcctattcacccatctatagcgctgcttaaatagggagtcttccctgatttttttccaggcagcttcaaaagttcataca

SEQ ID NO: 94278 - DNA, 393 bp, Homo sapiens
ggctgcagtgagccgaaatcgtgccagtggattccagcctggcgacagagcaagactccatcaaaaaaaaaaaaaagaaagaaaggaaggaaggaaggaaggaagaaggaaagaaatctgttgttagtctgatgggaattctcttgtacgtagcatgacacttttatcttgctcattttagaattctctgtttgtccttttgacaatttgactaaaatgtgccatgtagaggacctttttgtgttgaatattttggaaacttttaagcttcctggaactggatgtccacatctcttccaggacttgcaaagttttcagctattattttattaaataggttatttacaccatctctcatctcttcttctgaaactcacataatatgaaaatttt

SEQ ID NO: 94279 - DNA, 941 bp, Homo sapiens
gaggcattgtatagtagtggcaaagaatttgggttctggcattaattgtacagttcaaatcctagatctgcctcttgctagcataacctgttttcatttctgtaaaataggaatatgaataacaatgattatttcatagagtggctgtgagggttaactgaatttcatgtagttaaccctcaataaatgctagctattatttttctgaaaaatctcaaagttctaatacgtctaagctcatcgtattgttgtcatcatattgttgtagtaattgccctagttataagagatatgaagaaaaaagtatgtattcaaatttacaaagcccatgaaaatcactttcttgtagttcatttctatttgaggataaccccaggatacttctttcagtccagacagtcctgttcgctccaacccaaactcaactctaaatctaaaacttgtttgaaaaaaatttttaaagagctatctacctatcataagctaatcttaaaggctaaagtgggcttcttgatactacttattttggaggctagatcaatatcagtaagttcctttatcaacaggccccatacagattattttttttacttaaaaatacttgaacaattgaaatgactctgtaaaacatttaatttagttttataaaattggtggcagcctgggcatggtggttcacacctgtaatcccagcactttgagaggctgaggcaggtggatcttttgagcccaggagtgtgagaccagcctggacaatataatgtgcccgcatctccataaaaactaaaaaatataatagttgggtgtggtggcacatgtgtgttctcccagctactcagtgggctaaggtgcaggggcggggattgttaaacccaagaggttgaggctgctgtgagccatgatgatgccactgcactccagcctggcaacagagcaagatc

SEQ ID NO: 94280 - DNA, 119 bp, Homo sapiens
gaggcctcgggaagcggcccactggggttatcagaatcttcatctgcccacaccagcttcccaatgggtcctcctctgcctccctccaggagtcccggcccttcagccgcactgcccta

SEQ ID NO: 94281 - DNA, 355 bp, Homo sapiens
cctccacctcccgggttcaagtaattctcctgcctcagcctcctgagtagctgggattacaggcgcccaccaccacgaccagctaatttttgtatttttagtagagacggggtttcaacatgttggtcaggctggtctcgaaaccctgacctcatgatccacttgcctcggcctcccaaagtgctaggattacaggcatgagccaccgcacctggccagaaaagtcaatctcaaaaggtcacatactatatgattccatttatataacattctcaaaatgacaaaattatagacagaaaatacattagtaattgccagggcttagggagataggggtgtatgtgtgtgattctaa

SEQ ID NO: 94282 - DNA, 170 bp, Homo sapiens
gctcaggctgactcttgaggatcccccttcccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctaca

SEQ ID NO: 94283 - DNA, 137 bp, Homo sapiens
tacacgaatcccagcacaggatgtgactgtgcactgcccagttccccacctccatcctcctggtgtctctgtggatctgctccccacctccatcctcctggtgtgtctggatctgctccccacctccatcctggtgt

SEQ ID NO: 94284 - DNA, 551 bp, Homo sapiens
ggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaaagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94285 - DNA, 499 bp, Homo sapiens
ggctgctggtgatgtgtggggtgacacagcgagcacaggggtgccggatgccagcggctcgcagtatgagaatgttgagaacttagaatttgttcagaatcaagaagttctgccaagtgagcccctcaatttggacccttcctccccgagtgaccagttcagatatgggccccttcctgggccagctgtgcccaggcatggtgctgtgtgccacaccggagcccctgatgccacactgcatacagtgcaccctgacagcgtgtcatccagctatagcagcagaagccacggaaggctctcaggctcagccaggccccaggagctggttggcacattcattcagcaagaagttggaaaacccgaggatgaagcttcaggtagtttttttaagcaaatcgattcttctcccgtaggaggtgaaacagacgagaccactgtgagccagaattaccgtggcagcgtgtcccagccctcaaccccgagccccccgaaacctaca

SEQ ID NO: 94286 - DNA, 1006 bp, Homo sapiens
ctaaatctcccgttaaaagaatgacctggccagcatgcagagagcctggggttggtttgtggttttttttttgatttgcctgtttctgcatgagtgtgccgcgtgtgcagtgtgaaactctcttcctctcggagtgtcttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggtgagcgggtacggtgggaaaggggaaaggtacccagtgaggaggcacctccccatcctgccagacagggccttgccttctgcaagtcagtatccaatgtgtacgtagagtgttccgccttaaacgcctcacacttatgtatggtagagacggaaggtagaatgcagggtgccgggcgggacagagctgtttgggaagacggagatctggggatagtggcggtgatggttgctcagcacggtgaatgtgcttaaaacttaaaaatgattaaagtggcaaattttacagtatgtatattttacaatttttaaaattggaaaaagtaaaattaattactctaagttacagagaaattacctaccgataataaaagttaagtatattttcatccaaaaaaaaaaaacaaaaaacaaatgactcccatgtgaagtagaacagctcagaccagtcgggagtggtggatgatgcctgtaatcccagctctttgggaggctgagctgggcgggtcacctgaggtcaggagttcgagaccagcctggccaacatggtgaaaccccatctctactaaaaaaaaaacaaaatttacctgggtgtggtggcgggtgcctgtaatcccagctactcagaaggctgaggcagaagaatcgcttggacccaggaggcagaggttgcagtgagctgagattgcgccattgcactccatcccgggca

SEQ ID NO: 94287 - DNA, 3765 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94288 - DNA, 3705 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94289 - DNA, 3630 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94290 - DNA, 3690 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94291 - DNA, 3586 bp, Homo sapiens
ttagcggatccttggaggcaggacactggctaccatgggcgatactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94292 - DNA, 3692 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94293 - DNA, 4170 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctgggtaggtcaggggtggagatgggcattgggtgtcgcggatggagcgccgaaggcccggttgtctgtggcgttggcagaaatcaccagaacccggccttctcggtccggctggcgtctctggtgccttctgtgcgcgtccttgacttctgcaagcgctcccggtcgctgagcccccgccgtgtgtcgtgtcgtctctccgcagcttcaaggggcctcttggatgcggcccacttctgctacctcatggcccaggcgggatttggtgtttacacgaagaaaactacaaagcttgtcttaatcggatccaatcacaggtaaagaaccaagtcagtgtagtcctgtaagttttcctttcaaagtaaaacaaaatccttctcctttagtgaattcagaaatggccagaatcatgtctttatttgtcacgtggtgggacacacttctggatgatttgctccaaggttgactatgccaataattggccattttttccaaatcaaaataattcacttcctctacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94294 - DNA, 3721 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcagcatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94295 - DNA, 3615 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggaccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94296 - DNA, 2686 bp, Homo sapiens
aaggtccaggctggtacgcgtcagagttcgtagctccatcctcctggtgtctctgtggatctgctcccacctccatcctcctggtgtctctgtggatcgccccccacctccatcctcctggtgtctctgtggatcgccccccacctccatcctcctggtgtctctgtggatctgctccccacctccatcctcctggtgtctctgtggatctgctcccacctccattctcctggtgtctctgtggatctggcgactctggggcctcacagaaggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94297 - DNA, 3711 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94298 - DNA, 1545 bp, Homo sapiens
gcaggcgctctagaggacccctgacacgccgagcatccataccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94299 - DNA, 3760 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaatttttttttttattccactcaccccccaaccccctcccgccgta

SEQ ID NO: 94300 - DNA, 3241 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctgtgactatagagacggcctcctctgtgctgtcagagagtcacaa

SEQ ID NO: 94301 - DNA, 2541 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggtgagcgggtacggtgggaaaggggaaaggtacccagtgaggaggcacctccccatcctgccagacagggccttgccttctgcaagtcagtatccaatgtgtacgtagagtgttccgccttaaacgcctcacacttatgtatggtagagacggaaggtagaatgcagggtgccgggcgggacagagctgtttgggaagacggagatctggggatagtggcggtgatggttgctcagcacggtgaatgtgcttaaaacttaaaaatgattaaagtggcaaattttacagtatgtatattttacaatttttaaaattggaaaaagtaaaattaattactctaagttacagagaaattacctaccgataataaaagttaagtatattttcatccaaaaaaaaaaaacaaaaaacaaatgactcccatgtgaagtagaacagctcagaccagtcgggagtggtggatgatgcctgtaatcccagctctttgggaggctgagctgggcgggtcacctgaggtcaggagttcgagaccagcctggccaacatggtgaaaccccatctctactaaaaaaaaaacaaaatttacctgggtgtggtggcgggtgcctgtaatcccagctactcagaaggctgaggcagaagaatcgcttggacccaggaggcagaggttgcagtgagctgagattgcgccattgcactccatcccgggca

SEQ ID NO: 94302 - DNA, 600 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccagatggcttcccagttacgactcttcgatccccagctgaaagagaagccagaagaggagtccttggccgcacccacgtggctggttcacctgcagcaggtggagcggcagattaaggagggggctggattatgcatcagtggggacaccccccgc

SEQ ID NO: 94303 - DNA, 287 bp, Homo sapiens
gtggggctttgtgcctgtggtggtccaacgcgtcctcacctgagagccgttgttctccttcctgttcctgttgacccaaacagaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagag

SEQ ID NO: 94304 - DNA, 542 bp, Homo sapiens
gcttcaaggggcctcttggatgcggcccacttctgctacctcatggcccaggcgggatttggtgtttacacgaagaaaactacaaagcttgtcttaatcggatccaatcacaggtaaagaaccaagtcagtgtagtcctgtaagttttcctttcaaagtaaaacaaaatccttctcctttagtgaattcagaaatggccagaatcatgtctttatttgtcacgtggtgggacacacttctggatgatttgctccaaggttgactatgccaataattggccattttttccaaatcaaaataattcacttcctctacagtttgccattcttaaagttcgcaaccaacgaagcaatccagaggacggaagcctatgagtacgcccagtccctgggtgccgagacctgccccctgcctagtttccaggtaagcaggtgctgccagcctgcagctgtcatggctgggcaggcactcagtgctaacaagcttttggctacttagattgtttgaattggtatcgaaaaaaatgacgtgagagagggaag

SEQ ID NO: 94305 - DNA, 471 bp, Homo sapiens
ttcccagttacgactcttcgatccccagctgaaagagaagccagaagaggagtccttggccgcacccacgtggctggttcacctgcagcaggtggagcggcagattaaggtacagccttggcttggggtggcacagaggcgtctggcaaggtggcttctgtccctgtcatttccacactgaaagtatgtatctgtaaagacagtgtaactgcaaacgtgtgcctatgagaattccctaattccccagaaagggctttgagtgcctcctgtcctgaagtagggacacagcaagcgcggtggtggcaggcgggcagcgctgcagagcggccacaggcggcttccacagggcaggtcttgttctccctcaggagggggctggagtatggcatcaggatggagccctcccgcagcagtgtcctggcactccgagttccgagatggagcagttggacaggccaggactcagtcagc

SEQ ID NO: 94306 - DNA, 323 bp, Homo sapiens
ccccgacctccattctcctggtgtctctggatctgctccccacctccatcctcctggtgtctctgtggatctgctccccacctccatcctcctggtgtgtctggatctgctccccacctccatcctggtgtctctatggatctgctccccacctccatcctcctggcgtctctgtggatctgctcccacctccatcctcctggtgtctctgtggatctgccccccacctccatcctcctggtgtctctgtggatctgctcccacctccatcctcctggtgtctctgtggatcgccccccacctccatcctcctggtgtctctg

SEQ ID NO: 94307 - DNA, 296 bp, Homo sapiens
tctttcgttggctacctggaaagaaaaagacagaagcttatttgccagatgacaagaacaaatcggtgagtgctgtcaaatacgcacgggacgtccgaagaattgtaatgatttttctgtcactttcagagcagacctgagtaggtgtttcctgaagttttgaagtgtcatcattaatcagatgctaattctgtttaggttcagtctgctgaccttttttctttttaaaatcttggcagattgtttgggatgaaaagaaaaaccagtgggtgaatttaaatgagccagaagaggag

SEQ ID NO: 94308 - DNA, 4297 bp, Homo sapiens
  misc_feature (4295)..(4295): n is a, c, g, or t
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcaaaaaaaaaaaaaaaaaaaaaaaaaaaaaaaaaaaaaaaaaaaaaaaaaaaaaagaaaaaaaaaaaaacaaaaaaaacaagaaaacaaagaggaaaaccaaaccacaagaagcaatcacgacagcgcagacagcagacgacacatataccggcgcgggcactaccaagatcaacgtcaataccggcttccacggagcaatccccgcgccagaacaggacaccattactactgaggcaatcgacctacgggcaccaaaaccctacggagagtaagaaccaacgatcatctaccagatgtgaaaaaggagcaccacccgcaggatgcagacaggagacaggacaaaagccgtggccagaccacgggaacgccacggcctaaccggcaactcgggatgagatgaaaaatattgacccacgggagctgtatggttcgacacccagtgaaccggcgagccacagaaaaacactgagccggaagaatcatatacaacatatcacagccagaacagaaaacaccacagcacagagganat

SEQ ID NO: 94309 - DNA, 3716 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttgccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94310 - DNA, 2524 bp, Homo sapiens
tcgctattcacggcaccagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagagctttcgcgctgtagttcaatgagttcattatcacgtgaagtgagccagcattttaatcaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgccccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagca

SEQ ID NO: 94311 - DNA, 342 bp, Homo sapiens
atcatgtccggccggcttttttcttttagctgagccagcatggggtctttctgtgtttatgtctgcctaggtttgctaacagcctcccaatcaacgaccctctgcagacagtctaccagctcatgtccggacggatgcctgccgcgtccacggtgagtggcactgcctggtggcttgcacaggctccactgcctgtgtggagtttgctcgtgggtgacgctgtcacaggccgtgaggtgcctggtgagcccagctgtgtggaattgaaatggcgctggcttccggggatgaggcttcgttttgtttttcctcatgttagtgctgtggagacgagaaatgggg

SEQ ID NO: 94312 - DNA, 312 bp, Homo sapiens
tgtgcccacgaagtgggaagatgttcagccttggtttctgcagatcatgctggtgtggcggtagctgggtgggaaggtggtgtgcctgttgatctgtgcgccacacacacgtcccgccttctcgtgactgagatcatagttgctctctttcccgttgacagggatagtgccgcaggaggcgcctgttggaaactcactttccgagctaagcgaagaaaattttgatggaaaatttgctaatctggtactttgtcacattttcttaaactgtttgttttccataaagttcatcgagtgggcacccagactcct

SEQ ID NO: 94313 - DNA, 720 bp, Homo sapiens
gggcctgggtcgtggcctcgccgagtgagtgtttccccggtcaggatgctctcctttggaaggaagattgctcctttctgatcaagcatgagaacgttggtttgaggccggggcgggtgcagcagtgacctgcggccaatgtgggagggaggtgaacgaacgcttcatcttctgcctgtccaggcaccagctgcagccgtggctcagcagaaaggcttgcagcgacccttccgcctgcaaatgagagccctgggcctcgtgtcatggctggagccttagagctgcagccgtgggcacctcctcaccacctcgcacgctcggtgccacctcagtgctgtgtgcaccttcccattgcatgttccggtgcttaaaacattggctctgcacgttgctttgattttcaccatttttctctgaaccattaaataactaaatccagtgttgcaagaagtgtcttggatctgcttctgtagcttatgtaaaagtactgtaaatcccacccagaagcggtgtctgtatctgcacttgaagtgacagctgctgtgcagcgcagccctgctgaggtgacttctctgtgcttctcaggctcctggcgacctccctgctgcagggggccctcccagcggggccatgcccttctacaaccctgctcagctggcacaggtgagtgactcctacctttccctacgagaccctaacacgcccactgacgacctgacc

SEQ ID NO: 94314 - DNA, 240 bp, Homo sapiens
aaaagaaaaaggaaagtttacgggaattatagaacagcttcaacagagcaaatgtacatggtataggaattaagaagagagagactaaaggatagaaagcttatttaaagaaataataacagaaaatattccaaatccagggaaagatgtatatatatccagatacagaaaagaaaaaagtctacaagcagactcaatccaaacaagactacatcaagacatattaaatcagactgtgaa

SEQ ID NO: 94315 - DNA, 534 bp, Homo sapiens
agaggtttggggaggctctgctgtactgggactggtggcttgcacttgttagggtaatagctaatcccttcagcccatggcttttgtggctaatgtaatgctacatttccagttattttggggagagtgtgagtgacccagggtccagtcacatatgtgttcccctgggttgaggttgtgctccaagccaaaaccccctgaggcagctgccagtgcctaccacactgagaagccaagccaagaggctggaggggattgggggcaatgggtgagtgtctgtttcaaacctggttagtcactaaatttgcttcaatgactcctgcaaaaattgaggaaacacaaatctataagtaggagaatcttctggaagcctgctcatgaattctatgcaaagatgtcacagtctagtttaactttgtagaataatggtaagatgatagtcataggataacataaacaccattaacaaccctagtgagcttttttttggtcaaggtttcacagcacatgaggctaggatttatctgttgactg

SEQ ID NO: 94316 - DNA, 237 bp, Homo sapiens
aattgtgtcagcatcgtcatgtcatgctcatgttttcccttccagctgtgctgtgggcagtgtttagttcatgtctgctttgctggcgggccgagtagcaacagctgcagttggtgtgttctctgaaggcagtatccgaaggctggaggggttgcttttcttcccaggtgtcttttgaagaggcagtcaagtcagcagctcgcggtgaccttctggtaacatcgtatgggctgggtt

SEQ ID NO: 94317 - DNA, 543 bp, Homo sapiens
tggagcagacacacaagaggtgccccactgtgagaacggtgtccgtccctggcaaacctctcgacccctccccgctctctcttcccttttgttcaatgcagtaatggattacaaagtgctttcaaaagacaaagtgccatacaaactcaagaaactattattagctacggagcttccccattctgtgtgccctgtggacggcccagaggctgttaacttcctgttgccagaatttggagctcctgagaagaaaggttttgagagagaccagggtcaagtgagcctctgaattcaatcagcaggaagctgcagtcctagcccgtccgagacaggatggtgccaagaggtcagagaggccattccttcgttttccacgggcaggacagggactgaagtaaccagccaggagcggggtgggcagtggctgagctggggctagaacccccaggctccggctgccccctggaaacttcccactccacccttgttgccgctcctgggatcttttggtttgaaaaaaaaccctggggtttaaagtcaacc

SEQ ID NO: 94318 - DNA, 329 bp, Homo sapiens
cctaggaggaagtctggcagaggaagccaatttataccgggctggtgtactctccccagctcagcccccagtgtgggcctcagatgccaggccagatcaggtagcagaaagggccccagaaaaggggaagaggctagacttcatcctggctgggtgatgccgggcctgtgcagacacagcaaatgcagcacagcaaggcatgctccttcctcctgagcctcaattcagcctcagaacttctctcagaacaacccaggcagtcgctaccatagatttggccttggcacagaggacagacctgattccctcaggctttcttctttgtaaaa

SEQ ID NO: 94319 - DNA, 266 bp, Homo sapiens
ttccccctaaccttgtgagtgggccttttaagtagtaagtagtatacacctagatatggatagatagctaggtgaccaaacctaatggattaaggccatcctcgcctaggtcacttactaaagatcaggtcatatgtcatatcgttcctgtgctttttagaacgtatttgggaatgggttccagattttttttaaacacatattaaagattatttatattatgctttgtttccaaaaggttttaaggtggattaaaatataagatt

SEQ ID NO: 94320 - DNA, 445 bp, Homo sapiens
ttgctggaaatttaatttgcccagtggtagtgccaaaaataggtactttctttctgttggtgtatgattgatttatctttgcccattcctttgcttttaaccttttgacatgacctataactttgttgcagttgtatctagactaaaataattaagttattcacggtacactaatttgaacttttagttgcactgatctcataatagaatttataggtcatttgggaaaagtggtagattttagaaaataaagtatttataattttagaagtcaagtaagtttttagtaatatttgtgtacaggagaagttggtagccacatttcagacaccatgacccagaaatagcaaaaacatcaaaagttcattatttctactagataccttttacaaggcggtattattaaatgatgaataacttatatggaaatcatttatattactag

SEQ ID NO: 94321 - DNA, 799 bp, Homo sapiens
agcggaataaaagaccaaatcatctgctataagaaccaggagagtggtgactgagtctcagcacattctagggacaggagaaaagcaggtggctggggaaaaacccagtgggagtgctcacagcagagaacgaagactcagccaagctccattcgcacttcctttcccgtagcattggagacagagctcctggggctgctggtacctttgaaagggctcataggaaaagggagatccatcaactgcctccttacaaaggaggtactgaaacaaagcaacacaactgagaagaccaaaaatgtgtagaaagtcactatgcatggaatgagctggctgtttcaatattagcttctgtttgactcccacatgcaattcaaaggctcactatataacaaaaatagtctgaaattcatctttgttcaccaatccattgtggactatagaaactcagatttcctaccagttaaaatgtaagcagtaaagccaggtgcggtggctcatgcctgtaatcccagcactttgggaggccaaggcaggtggatcacttgaggtcaggagtttgagaccagcctgaccaacatggtgaaaccctgtctgtactaaaaatacaaaattagccagatgtggtgggcatgcctgtaatcccagctactcgggaggctgaggcaggagaatcacttgaacccaggaggcagagattgcagtgagcaaaaggttgcagtgagccgagatggtgccaccgtactccagcctgggcaagaagagagaaactcttgtttcaaaaaaaaaaaaaaaatgt

SEQ ID NO: 94322 - DNA, 608 bp, Homo sapiens
aggaaggcaggggaagtgcagggcatgcctgaggtctgctgagtaggtaattccaacattccaagtaggagttgggtacagagtattgaatcttagaatgaaatgtgctatgttcacctgcatcaatagctctatctaattgtatccaagttttcttgaaaggaaaactacttttaccttttttatggccaccatcatgtctagtgtagaatgtgaaagttagtgttgcccagtggaaacaggcaggcatcttgattccacatcttggctgtcactcatgagctctgtaacttcggacaaaacatctcttctatcagattatatactgaggccaggcacagtggctcaatgcctgtaatcccagcactttaggaggctgaggcgggtggatcacttgaggtcaggagttcaagacccacctagccaacatggtgaaacctcatctctactaaaaataaattagccaggcgcggtggcacatgcctgtaataccagctgctcgggaggctgaagcaggggaatcgcttgaacccaggaggtggaggttgctgtgagccgagatcatgccactgcactctagcctgagtgacaaagcaagactctgtctc

SEQ ID NO: 94323 - DNA, 926 bp, Homo sapiens
gctagtttggccctctccctccctcttcttatattccccagtggctgttgttcccatctttatgtcgaggtgtaccatatgtttagctcccacttataagtgagaacatgcaggtatttggttttccattattacaacattataataatgttgttatttctggcatagttaactggataggagttcacgtttccaggaagtttcccccttttaacattttaactaagataatgaaaatgtggcaatatacatacttcactttttgtgactgattctcagtaataaaaaaacagctgggcctggtggctcatacctgtaatcctaacactttgggaggcccaggtgggtggatcgcttgagctcaggagttcaagactagcctgggcaacgtgatgagaccccatctgtacaaaaaatataaaaattagctgggcatggtgtcacacacctgtggtccgagctacttgaagggtcaaggtgggaggattgcttaagcccagaagaaggaggttgcagtggactgagattgtaccactgcactccagcctgggcgacagaatgagaccttgtctcaaaaaagaaaaacagaaaaaattcaaaaatcatatttctggtaatcgatacaccattgctggatattaaatattaataaatattttttcacgatttttattttgtagatggtcatttgattaaaatgttaggtaaagtagagcaattcagaaatatttcacctaaaatcacagcgctttgggaggctgaggcaggaggattgcttgaggccaggagttagagaccagcctacgcaacatagcaagaccctttctctacaaaaaataagtttaaaaaattagctgagtgtagtggtgtatgtgcctatagtcctagctactctggaggctcaagcaggagaatcagttgaaccc

SEQ ID NO: 94324 - DNA, 413 bp, Homo sapiens
ttctctattgggcaacccaacaccggaatctgaccaattcctcaatcactttcatattaaaagtttttttctgatagccgatagtctttcaagccaaaggaattagtcaagactctaggacatagtctttagataaactgggaccatcttctgtgaagccctgctataaaggaaagaccctgagtaaagaaacttcctcgttaactttacaatacagtctcacctctatgcattcctctatcaatcctttattcatgccatcctttttactaaaatcgagaaaaaggaaattgagttgttaacctcacatacacacaaaaaaatcacatggcactactgaaaacaatacaatggacttcacagcagtatattattttaaaaaacaatagaataaccttagttgttatgtctca

SEQ ID NO: 94325 - DNA, 415 bp, Homo sapiens
gtctgaatacctgtaacaaaacctctgttttttccttatggaactccaagagtgtaaacaggcaaatttcacttcagatcttaagctgcttgcttgtattgtgttacctgatttttttccaactaaaatagttattacaacagaggctactcttgtatgtttaaaataagaaagagtgtcatttagacacttacagaaatgtctttgtaaaaaagaaaaaaaaggtgcactgtaaaaacatggtctaacctcataataattctctcatggagacccaggatacagtgtagattctgctcagagctcaaagattgagttaaaagatgcagagtaaaattagaactacctattaaataaaattggttttcttacacaattctatgatagaattatataattttatgtttaacttggc

SEQ ID NO: 94326 - DNA, 780 bp, Homo sapiens
agtccggggctagggactgggggagtttagacaagaaagcacagaagaagccccaggaagtgatgggagtaggagacagacaaagagggtgtttgagaaatgtttctataggcaaagtatctcctgcatgggactaaagagacataaaggacgggagcaatttttgaaaatacaagtggatgctagactgcgtttctttgaacatcacatcagcctgagaccagcccacatgaatcatggcttcaaaggggtgacaggttaatctggcagcagaacttatggaggatgatcagaaagagtagaagaaatatagaggtgaagggatcattggaatagacttggacttggggactgaatcactgcagagggataaagaaggaggaagagtcccaggtttcagtgcagaatagtcacataggggatgggagatgagactcagcttggatgccttcacctctttgtagaggttgtccagagcaccgtgttgaaaaacattacgaggtcaatctgggaaaatgttatggccaaatggagatctttgccatgagctgcggagctagctctgcctttattgaccctgaacttagggaataacagcattgttgacggcattgatggcttaaggacatcagcatggaagctgggtttctggaagagagaatgaacttggctgaaactgaagcaatgcacaccgcttttgctatttgtttttgttttgtttttttctttttttccaccatcgatgcattttaaagttcccagatttgtactccagtacca

SEQ ID NO: 94327 - DNA, 533 bp, Homo sapiens
agtagtgatgatgatcacacttgcacctttagtatagggccatggtgagaattaagtaagatgatccaggtgcctggtcagggtaaatactcaaatgaggccgggcgtggtggctcacacctgtaatcctggcaatttgggaggatgaggcaggaggatcactggagcccagaagttcaggccagcctgagcagtgtagcaatacctcgtccctatttaaaaaagaaattaaagagaatatcaggaagaatagctaatgcatgctgggcttaatacctgggtgatgggatgatctgtgcggtaaaccacaacggcacatggttacctgtgtaacaaacctgcacgtcctgcacatgtacccctgaacttaacagttggaaaaaaaatttgcaaggtgtggtggcgtgcacctgtagtcccagctactcgagaggctgaggcaggaggatcacttgagcctgggggggtcaaggctacagcagtgagctgtgatcatgccactttactccagcctaggtgacagagtgagatcc

SEQ ID NO: 94328 - DNA, 833 bp, Homo sapiens
agcggggtagcaggcggaagtgcggccctcgaggcggtcgcggcctgtcggggcttggagcgaatggctccaaggccgcaggctgggcctgggccgcagccgtgggaagccgacgatgcctgaggcgctctgccctcggcccaccctaggaacttgtatgaccgcaggaaaggatcaggagaggccgctgcccgtctcccaccggctctaggctccctcggccgaccgatgtggggaaggggaaggggcccgcgccgaggctctaggggaggctcctaggccgggttctctgacttaaggccctcttggctgtggttttgcgggagtgagttgagggagctgcattcactcaagtccctcacatgcccgagggcccgggaatcgtgaagccgggcctgcggacccggtgggaggaaggagtgcgaagcgcggccgccgtgctcggccggcgccgggctaggtcgggcggtggggaccgcgccggcataggacaacgcggtggagggaagcacctgcccccggccaccttgactcagggccgccgcgcccctcctgggccatccgcgcgggggtctcaggatggcgaaacccgggacctcgcggccctctagtgctcccctgccagggtgcgacctaggtaccctttatcgagccccactccccaaggcagagagagttcgacgttcccaaggagggagtctccatggaggaattcgtcctgcttcacttccagagttgaaagcccgtcggttctgcaaagaggagcagtcgggcgcgggctagcaagcagctgatgaaaataattgtcctcgcacacacagccctgcgcccag

SEQ ID NO: 94329 - DNA, 1816 bp, Homo sapiens
cttggacatggctttaccgagaaataaatgaattaataagcataaactctaggccatacttaggtcaaaataagtgaagttacagtgagctcctcagattcttctagaaagtaaacaacccatcaatctttaatactaagtcatctgaatatgaactagcatcctaaaagtgaaaagctctaatggtacattacaaattcctgagtcattttgtcctcacaactttatgctttaaataaaactggctaaagaaaatctacaagtgactcagtatgacttagtgtttccaaaccaggaaaaggaaggactttcagtgtttgagataaggtttttttctgtagtttggaaaataaacatttcctattcagttatgcccaggggcagggtgtgtgtgtgtatgtgtgtatgtgtgtgtgtgtaggggaaggagtgtctgtgtgagtatgaaaagagaagaagagcaggaacgagggagtaagacagggaaggagagagggagaagggagagaaagagagggaaaaggagaaaaagagatttttttaatcagtatttggtgttcacgtaaaatggttactttctgcaaaagttacctcagcaaattatgtgtaagcaagccatggaagcactgcaatttgtaataaaatcaatgggaatggcttacctgactgtatatagtagataatccttatctatggggaatacattccaagacccccagaggatgcctgaaaccatggacagtaacaacccctaaatatactattatttttcctatacatacctacaataaagtttaatttataaattaggcacagtaagtgattaacaacaataactataataaaacagaacaattatactgtaataaaagttatgtgaatatggtctctctcttggtttctctgtctcaaaatatcttatcgtgttgtaccatgggtaactgaaactgcagaaagtgaaattgcagataaggggggattactgtattgcattctgtactgcatttccatgaattcagtgacacacagtgatgtattccatgtcgttatagcaaataataatcttaggtgtctaaattagactgaattttttatttcaataggcataagccattttctgcacctaaatgaaagtagcattttttttcctgatataaaaatgggcagatttttgtcctggtgtcatgctaatataaccccagaggtggcaagcatagtggctcaagccagtaatcccaggactttgggaggctgagacaggaggatcacttgaagccaggagtttgagataaccccagaattatctactttatttaaagtacattttagctgggcagtggtgtgcatctgtagtcccagatacttgggaaagtaaggcagaaggatcgcttgaacccagaagtttgagaccaggcaggacaacacagattcagtctctaaataaataaaatacctaagaacactcagagtggctgaaaatgtgttcagcaaaatctgttccactaatgtccctaataacgtcagtagagactagggattaatgagactaccaataaacacacatacacacacatgaacatacacacaatgtttactatcttgttttctgttataaggattgctaaatatttttgtatgatatagacagttacaatttatattttttagagaattcatagaaataatccttaaaatatttagagattggtactcctttgtcagataaataaatgcaaaagtgaaaattatttcaaaccaatagcacatatatcccatgatatccacaatggttttattttatccatcacttgaaagt

SEQ ID NO: 94330 - DNA, 1263 bp, Homo sapiens
gtcttctaaattttagttataaaatacattttaattatatgtcaacaatttgcctcaaccctaatctcaaatatctagaacagctatatcacattatctaaacatgagtaaaagctgagtttctgctttagagaaaacatctcagaagatgtttagagacccccagaggatgcctgaaaccatggacagtaacaacccctaaatatactattatttttcctatacatacctacaataaagtttaatttataaattaggcacagtaagtgattaacaacaataactataataaaacagaacaattatactgtaataaaagttatgtgaatatggtctctctcttggtttctctgtctcaaaatatcttatcgtgttgtaccatgggtaactgaaactgcagaaagtgaaattgcagataaggggggattactgtattgcattctgtactgcatttccatgaattcagtgacacacagtgatgtattccatgtcgttatagcaaataataatcttaggtgtctaaattagactgaattttttatttcaataggcataagccattttctgcacctaaatgaaagtagcattttttttcctgatataaaaatgggcagatttttgtcctggtgtcatgctaatataaccccagaggtggcaagcatagtggctcaagccagtaatcccaggactttgggaggctgagacaggaggatcacttgaagccaggagtttgagataaccccagaattatctactttatttaaagtacattttagctgggcagtggtgtgcatctgtagtcccagatacttgggaaagtaaggcagaaggatcgcttgaacccagaagtttgagaccaggcaggacaacacagattcagtctctaaataaataaaatacctaagaacactcagagtggctgaaaatgtgttcagcaaaatctgttccactaatgtccctaataacgtcagtagagactagggattaatgagactaccaataaacacacatacacacacatgaacatacacacaatgtttactatcttgttttctgttataaggattgctaaatatttttgtatgatatagacagttacaatttatattttttagagaattcatagaaataatccttaaaatatttagagattggtactcctttgtcagataaataaatgcaaaagtgaaaattatttcaaaccaatagcacatatatcccatgatatccacaatggttttattttatccatcacttgaaagt

SEQ ID NO: 94331 - DNA, 228 bp, Homo sapiens
gcacttgccaaggcggccctcaggagtggcactggctcactaggctctgagccttcctaccttcgtgctcaggcgcagccatggtttggggcctggtcaagaacaaagaagcaggtgaaactctgggacccactgctggccttctttcctagggtgctggggagtgacgtagggcaaagatccctgggcaagtgagggcacaaggtgtcaaaaaggcaccttccctag

SEQ ID NO: 94332 - DNA, 839 bp, Homo sapiens
aacaggtgctctgataccagtggacgtcagagtagaacatccgtttctgcagtgatcaagcagggcctctgacaagtgagttttgctgacgagaaggggttaaccctagaagaatcagtgatcagtcagttccagcaagaacagcccagtctgggcacgaaagggttcaccttctaagggggcacccggagtgctgtggccacagcccagagcggggagagggagtgggtgggggggctccaccaaagtctgtgtccttccagaacattaggagggcggggaagggttttgggcctcagctacctgagtatccctctcccattgtaaatagggagggctatgcctaccccgggtcccaaggagaaggggtgccaagatgtgctgattagttcagttctgtgccttaaaagttagcctgtcttctctaggcaggcaatccttctctgcagcagaagaattgagtctttagtttttctgttgttgatgaacacaggtatccctggtggggcactctatacctgccctaaccaggactgctggggttttcattccagagtggccagaaagggtcaaggcagcagacaggcatcaggggttagctgtgaccttttgttcctattattagatcctcagcagccatctgtcccattagcctccagcttgtggtggtgcttgggcctcaccaactcctggtacctggccagggctagggtgtggtcaggctgttgcccaggagcccagttaccaacctcagggtagggctgccacctcccagcctagaaggccatgagtcacccttccaccagcagctgagggtccccagcgagtttctaaaatta

SEQ ID NO: 94333 - DNA, 894 bp, Homo sapiens
ctcccctctctaggaccagcaataaggagcttcggcacctgattgaggtctccgtggttttatgggctgttgctctgaccagctggatcagtgaccgtctgctttgcagcttctggcagaggattcatttcttctatctgcacagcatctggcatgtgctcatcagcatcaccttcccttatggcatggtcaccatggccttggtggatgccaactatgagatgccaggtgaaaccctcaaagtccgctactggcctcgggacagttggcccgtggggctgccctacgtggaaatccggggtgatgacaaggactgctgagacctgccagcctcttgactatccaaccacccaacaacttgcctgtgtcttgagaagatagccccggtcaggacttgcacctgcgggacactcgtggttccttcctctgtttccccttccgtgtcctccttgtcctgcgctgccctgccttgaggcagatgatggactttgtgacatctctgagcagcagcctggtgactgtggggggctgtctcgtgcatctcccctccatgaccccccccatcctctttcatttcctcctctgtgtccacagcctcccagtgaccattgtcacatgagctggtgggactgtgtcaccaggtactggggtgactgaaggatgtggcatctaaatattagcttctaggctgggaacggtggctcacgcctataatcccagcactttgggaggccgaggtgggtggatcacctgaggtcagaagttcaagactagcctggccaacatggcaaaaccccgcctctactaaaaatacaaaaattagccgggcgtggtggtgcatgcctgtaatctcagctacttgggaggctgaggcaggagaatcgcttgaaccca

SEQ ID NO: 94334 - DNA, 2286 bp, Homo sapiens
atgagagcgagctccagtggcagactctagtttctggaataagagcaatacttttaccttcacaggtttgagcctgttgtttgctatattttataactcgttaagagttttttttaatgcactggtatcttgaaggagttcttttcctctggcagtagacctctggttttataatggaaatctttgaacaagtaagatctgcttagatttacattcatctttggtagagtaaacctcatctctaaattaaagagtttgtaatttcttacctttatgattagaatgaaaattcttggagagggcctaatccacatgtcagtttttaaagcttaaagacaaaagacaacactggcatttgtgttaatatctgcatttaaatatatatcatacacacacaaacacacacacacacacacacttagctatatggaaaaaatggatccctaccttacagtatatgcaaaagtcaattctagatgggaaattaaactttaaaaatttttaaagaaaatacagggcaatatctttatgacctcagagtaaagagggatttcttaaacaagaactacagctcataaaggaaaaagttggtttattttattactttaaggaaaaaaaaccttctatatatcaaaagacgtaaagaaatgaaaagccaagccacacagtacagctactttggaattatctttcagaattcatgtgtacaccctacagcgctgcaattctacccctagtcataggccctggagaaactgcacatgtgaaccaggagacattcagaagaatgtttattgcattttcataatagcaaaagactgggaataatccagtgtccatccacaggaaaacagttacattctggaatagaatattttgcagcagtaaaaataattgaacgaacagctacttgtgacagtgtgaatcaattttagaaacaaagttgagaggaagaatctaatagcagaagactgtatatagaatggtaccattttaataaagctcaaaaataaaactaagatctcatttagagagatagatggcaaaattctttttaaaagcagaggagtgacaaaacacgaaattcagcatagtggttaagagaagcaggagagacgaggaggagtacatgtttagctttaataatattggtattccttggttcttcagttgaactcgtggctattcattttcatgattatgcattataatttgataatgtatgtaattaacagatgtatgtatgtgacatatttacttttgggtaacaaatactacttcattaaaaaaatcacaataaaaataacaagcgtcaatctgggagaagatacttgcagtatacaaatatcttaaacagattaatgtcctgaattcataaagaattcctatgaatcaataagaaaaaggacaacacaacttaaaaaatactaatggacaaaggatctgaataggaattcataataaaaacctggatggctaattaaaatatgaatatgtgctcaaccctacttgaaataaagtaaatgcaaattaaaacaagatcccagccatgctggcacatccctacagtcccagctactcaggaggctgaggcaggagaatcccttgaggccaggatttcaaggctgcagtgagctatgatcataccactgcactccagcccgggtgacagagcaagaccccatctcttaaaaagaaaaaaaaagagatcccatttcatattcatcagattggtaaaaataaaaaaaaatctgacaaagccaagtcttgatgagatatggagtaccagaagctaatccccaccggggttggtttaaatagggactaactactttggaggacatggaagatacctcaagtttaaatgcttataacccaaggctcagcaatattctagttaatactctagaggaatgcttgcacagtgcccaagaaggtattaaaagaatgtttattcaggtgttatttgtcatagtgaaatactggaagcactgtaactgtccattacagaagaacggataaaaactattgtgactaatttatataacagtatagcatacggcagagaaatgagtgaactagagctacatgaataaatctcaaaacgaatgttaagacaaacaaggccggttgcggtggctcactcctgtaatcccagtactttgggaggctgaggtgggtggatcacttgaggtcaggagtttgtgaccagcctggccaatgtggtgaaaccctgtctctactaaaaatacaaaaaattagccaggtgtggttcatctcaaaaaa

SEQ ID NO: 94335 - DNA, 1226 bp, Homo sapiens
gcccaatctttaagaaataatgatctctcggttagctcttttcccacatatattggacatctttaatttttttgccatctgtgaaaattctgctctgtgtaagtattttactagtcacaatttatgggtatagtttggaaaatataatgcattcagagcagaattcggcacgaggatgtatgtatgtgacatatttacttttgggtaacaaatactacttcattaaaaaaatcacaataaaaataacaagcgtcaatctgggagaagatacttgcagtatacaaatatcttaaacagattaatgtcctgaattcataaagaattcctatgaatcaataagaaaaaggacaacacaacttaaaaaatactaatggacaaaggatctgaataggaattcataataaaaacctggatggctaattaaaatatgaatatgtgctcaaccctacttgaaataaagtaaatgcaaattaaaacaagatcccagccatgctggcacatccctacagtcccagctactcaggaggctgaggcaggagaatcccttgaggccaggatttcaaggctgcagtgagctatgatcataccactgcactccagcccgggtgacagagcaagaccccatctcttaaaaagaaaaaaaaagagatcccatttcatattcatcagattggtaaaaataaaaaaaaatctgacaaagccaagtcttgatgagatatggagtaccagaagctaatccccaccggggttggtttaaatagggactaactactttggaggacatggaagatacctcaagtttaaatgcttataacccaaggctcagcaatattctagttaatactctagaggaatgcttgcacagtgcccaagaaggtattaaaagaatgtttattcaggtgttatttgtcatagtgaaatactggaagcactgtaactgtccattacagaagaacggataaaaactattgtgactaatttatataacagtatagcatacggcagagaaatgagtgaactagagctacatgaataaatctcaaaacgaatgttaagacaaacaaggccggttgcggtggctcactcctgtaatcccagtactttgggaggctgaggtgggtggatcacttgaggtcaggagtttgtgaccagcctggccaatgtggtgaaaccctgtctctactaaaaatacaaaaaattagccaggtgtggttcatctcaaaaaa

SEQ ID NO: 94336 - DNA, 3319 bp, Homo sapiens
atgtgacctgttgactttgtatctgcacgtgggcacgagtgatgttcagtttgctaggcactagtcatagtgttatggacgtggtggagtgtaaggtcttgatgaattacggcagtatgcagaaaaggaaccaaggccagagagacaaataatgcctcatgtcccactgctttaaaattacattaatttataaaatggccactatgggctctttttgactgtttctcggagtaggaacaaaataagacattaaatggtggcttgaagagaaagatacacattttcagaagaaagaaaggggagggctgcagggagcctgtcttggcgggagctctccagtctgttggattagcacagggacacgcttatggtgccatgacgccgaaactagtcatcccccatctccagcataggcaacggcctgcaggggtgagtgtcagaaaagacttactttggaagaaaagggtttttttttgtttgtttgttttttgtttttttttgtttgtttgttttgggtttttttcctgaaatttcctgatacctttttcagaatgtcacccttgtaaataggcacctaaagccaagttggtcagcagagctcctgaccacggctgcctctgcgtgacaaggacatttgcagctgcctttggaaggctcttcacattaaaaaacaataattatgtaagtgtgtttcatagcttgagtcaagctttcaaggatcactgctcctttgtgcattgtgcatccctttggggaaagaaacagaaaattattctctttctatagagtcaagcaattccagcagaagtgaagaaatgttagtttcccagaaatcgcagtggaatagaatacaatactgtgttaaccaactttctgtataaatgcatcagtattcccttacatatgtctatatattttataatagaactgttagtgaaaatgtgcttgtttaagctgggtcactatgcaagagttacttccagtagaatgtagtgaatgtaattccctagtcggatattagggatgctgtagacccaagttctacattccagatgtccgtgcctatagtatactggatttattcttcatgttgcttaaatgcagttagctctggagggggatagctgcatcccttacttctgtgactagcaaaggacaaagtcccagcgcacagaatatgaaaacataccctgtgttagccaatcaagttacagcaatgctgtcacaaagggagttttagaaaactggggagtcattgtccgtagacagccattttgatttaggaaacaggtgtattagcatgagccttaggtcatgaactgcttttaaagattgagtttgaatatgggatctgtccacgaggaagagaaaatggctttacctttaggacaatctcattgtggactgctttatttatattattagtaacgctgttttaagtgttattctttttattgtattttatttataaaaaatgcctttatatattgaaatatataaatatatataaacacacacacacacacacacacacacacacacatatatatatatatatataattgcctttatatttaggcggtatgagttctccctaagcgtgagttggctctgccctgcacaggcacccaaacagtcctacctaatgtcacttcaccaggaaatgagaggacatggtacagtgtgggagacagcactaacacgtgctgaataactactgtgtaccaggcactgtgctcggtgcttgttactgttaactcatttaacccccacaactcatctacaaagttggcattaaaatccccaagtcactcagtgagccatgggacctgaatccgaacctagtttatctggagccataatctgggctcctcccatttttccatactgctttccaaaagcattgcggttcactctttggatggaaccagtcccgttccgtatgctgtgatctatccctgccgtggaattcctccgaggctccaactccgcagccggagaagctgctctctggcctccgcgggcagagctctgcttatgacttcgtcttccagaggtccacatttctccccttgacgccccctgtctaccacctccacctggaaatttgatctttactgtgctcagtgatcacgaaattggtcaagcctattcatgttccttctcatctagaattctgtgtgattgttttagcataaactgccccgctcccactgtatcatttcacgatctccttttaatgtttttctttcagttttgcactgacagtctggtgacaggtgctgccagggtgcaagttacattgcaatgttctaaaccttttgaagtgttcttagcaaaagcctttctttctgggtgtttttgtcgaatgagtctatgaagactcaatgcatccatcttgggctgatcatgccacagatctcattccagctatagtactgccaagaagtgaagtttatcattgaattttacctgtgttgctctcttttaaagtaatgactttgagatgcatgctttgtatcatattgaaaagtatgttttattttccttaaagttgtaatattgtgtgtgaaactgtacatattttaaatgatgtagctttggcaggttttatttggttgatatgattttatattaaaagagaaggctgctttcatatagcatagcccctgaaggtgggaatactccctgtttgtacaacgctgcttatagtttgtgattggggtgggcgaatgtcttcctctgaaattctttgggaaccccccacccctgtcctcccctggaaactcccctgtggcacacccctctgttctggactgcaggagatcaagggccctgaaggagcaggatcttgggcaagtgttttaggggacgctgagaacatacctgaccctgggggcgatgtggaggcaggcccacctcctcggggcaactttgcgtttccttggagggaagggaggtgggtaggagaggagcttgggaggatgaggaggagcggtcccgccctcacacattgtcctatttttacccattaaccgagcgccacatgtttatgaacttcaggatagaaatttagcctccttgtgaaaacgttttgttttactgccctaagaaaatacacatctctaggcttgtctgaccagaaagccagcaaagtcttttgcatcgggtgtggcccttttgtattttatttcccatatttaaataagccttccttaaaccctagccccagtcctgagagctttgagggtagccgaaaccccttatctaataaagtctaactctgtgagaaccacagaatcttcttaagcttctcaat

SEQ ID NO: 94337 - DNA, 435 bp, Homo sapiens
tgtgggatggacttgacccactgtggtgggctttgaagacggaggaagaggccataagccaaggaatgcaggcagcctctggaaactgggaagagcatggaaacagaatctctcctccagagcttccagaaaggagaatggccctaccaacaccttgattttagcccggtgagatgcctgtcagacttcttactttcagaactgtaagatagcatgtctgcattgtcaagctactaaatttgtggtttttgctagagcaccataggaaactattaatacactttaccacctatctgatggtttgctaagcactttcggggtgtccatcatctcacttaatctttgcaacaagcttagacatagacattattatccacattcgacagcaagctgagcttcagagaggtttaagagcttgatgagggtcacacagcc

SEQ ID NO: 94338 - DNA, 190 bp, Homo sapiens
agtgggctggaggggaaagaggtagggtatggtaatccacaagttgcaaaagaaaaggatcaagtaggataatagtcaattacatgttcacaggtaaatcagctgtttacctaagacaggtgaacataaagtagctacctgtggagatatttaaccttttatctgtagctatctgcttaggtacaaaagg

SEQ ID NO: 94339 - DNA, 767 bp, Homo sapiens
agcggctgaggtgacacttttttaaaaaaaattgtaaaaattgcatagaaagtgtccaaatatttatctttattgaaagaatttgtcttctgatatgctgtgtgagagttaaggtgatcttaatgtactttgtacctgacatgaatgtgtagttaatgcatgccaatgggtggtttgggtgatttagaataaccaactcatctcaaaaattttttacttattatctttcactcatagatttttttttccttttctgttccatttttagtaactcttctacataaaaattttttactgggctgggtgcggtggctcacgcctataatctcagcactttgggaggctgaggtgggtagatcacctgaggccaggagtttgagaacagcctagccaacatgctgaaacccgtctctactaaaaatacaaaaattagccaggtgtggtggcatatgcctgtaatcccagctactcgggaggctgaggcaggagaatcacttgaacttgggaggtagaggttgcagtgagccaagattgtgccactgcactccagcctgggcaaaagagtgagacgccatctaaataataataataataataatttattggcacagggctgctaattgtagaattttgcattagtgcttctggagggtcttgacatttacattgcctgctctatgccaggtgctatctttgactcctaacttttacaatctcatttaatacgtgaagaggttatataaaggctaatgctaatttaaaaatat

SEQ ID NO: 94340 - DNA, 760 bp, Homo sapiens
ggagtcagatgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattac

SEQ ID NO: 94341 - DNA, 858 bp, Homo sapiens
  misc_feature (761)..(761): n is a, c, g, or t
  misc_feature (766)..(766): n is a, c, g, or t
  misc_feature (774)..(774): n is a, c, g, or t
ggagtcagatgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattacnaacanaaaaaaanaacaaaattttggcggcggcgcgagaattttaaacatctgtggcgcgccaagggacatcggtcactccacaaccggcaaagggc

SEQ ID NO: 94342 - DNA, 495 bp, Homo sapiens
gaaaagggacatggcattgtgctgaaactcacaatctctgccctaaatggtgcctggaagaaataagttgaggggcttgtgcgaagggaaaggaacttcagcccagctcacctgtgaccccctccctgactcaccctctgcaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattac

SEQ ID NO: 94343 - DNA, 992 bp, Homo sapiens
cctagctttcctccaagaggaagctcttcagaaggaagtgaagtgacataacaaaaaagcatctggatttctcaaagaaggaagttgtcttttgaaaagcaactttcaaacattaggttttcagaggtctgtgggcaggcaggtcaggctaggagcacgcagcaccgggtggaccttgaccgtgctgccacctttcctgccctggagcaagtcctcggtgccctctgggttgagtttccttctctgggtgaggggtgtcggggtctgctctgggcctgtctcggcggatgggccttaacagggagctcctgcaggatgggcctttgactgcccccgcccccaacctgggcagggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggtgggtgtggggccgccccgccgtggggcagcctggggccgaggccagaactgtggaactaggaggaccctgccagcctctggctctctctcaggcggtggtctctctctcggcctcaggggctgaggtagaagggcacgagacaggcagggtggaagacgggccctcaccccactgcgggaggtttccctattagcctagaccctcctgttgcaaggaacagaaactcaaccctgagtagcttaagccaaaaagaaaaatgtatttgcttggtgactggaagatcctccagtgtcaggaatcttgctctcttccaactcgacttcctgtgtctgatccagcctcaggcaggccttccctgtgcggtggcagagacggtcccggcaaccacatcttgctttccaggagctgagcctccctgtgcagatgacagctgccttttcacagtggttatagcaggaacctcaggcctgactttcattggccagtc

SEQ ID NO: 94344 - DNA, 3489 bp, Homo sapiens
ggagtcagatgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtttcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctggacagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 94345 - DNA, 3265 bp, Homo sapiens
cacatggacaaggacgggtggtgtcttgaaggtgacaacaaaagaaggtggtgggtcccaggccacagatgttcctgatgcagtccttgggtctgtgtgtgctttggcctggctgccctgtgtcccctgtgctgattcaggtatccctgggaatgtagaaagtagaatattcatgaggaaacaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtttcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctggacagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 94346 - DNA, 3438 bp, Homo sapiens
ggagtcagatgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtttcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctggacagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 94347 - DNA, 1063 bp, Homo sapiens
tcggtacctgcctgttgttcatacgcccctggacagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 94348 - DNA, 607 bp, Homo sapiens
gatggccggacgccaagaagcttagtatactagtacacatacaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 94349 - DNA, 433 bp, Homo sapiens
gaggaggtcccggacgtcactcctgaaggtgggtgctggtgggagtcagggtgggagctgggcaggtctctgactgcttacgtggacccctcctttcttcctgccgcgtcctgcgcagccctggctttcccacggagccggcacctgctggctgtgttctttttcccatctcttctgtggtcgtgtggtttgtttctgtgtccccactagaattcacattcctgagggcaagatttgtgcctgacccatcactgctgcatcctagggcccagcacatagtaggtgctcagggaacacttgctgagtgcggtcagcgctgagacctggtaagggagaggttagccgagggaacgtgctctgggcgtcagggtggcatgagctttagaaactgcagatgaggtcatcagggagtgcttggagcggggcagctgca

SEQ ID NO: 94350 - DNA, 414 bp, Homo sapiens
tgggtgtgagaggtgtcacccggccgtgcctggcaggtttctcgctgcagcatgcgctacctggcgctgatggtgtctcggcccgtactcaggctccgggagatcaaccctctgctgttcagctacgtggaggagctggtggagattcgcgtgaggctggggccatggaagtggggggcgggggcgctgtgtcaggtgggccctagggccgggccagtaccctcttctcctctgggccacgggaggttctgagcagaggagggaggccacctgcttagggtgagccaggcgccgcggctgcccttttggttgaaggtgctggagcggtgtcccgtagtgatctgatgccaggtgtgaacacaatattaaattttgtaatagccacgttaaaaaagtaaaaagagctgggcacgg

SEQ ID NO: 94351 - DNA, 870 bp, Homo sapiens
  misc_feature (15)..(15): n is a, c, g, or t
agcgggggcgcagcngggagacagatgcgaggcggcggtcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattac

SEQ ID NO: 94352 - DNA, 892 bp, Homo sapiens
  misc_feature (15)..(15): n is a, c, g, or t
agcgggggcgcagcngggagacagatgcgaggcggcggtcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattaccaaaaaaaaaaaatctccaggg

SEQ ID NO: 94353 - DNA, 536 bp, Homo sapiens
cacatggacaaggacgggtggtgtcttgaaggtgacaacaaaagaaggtggtgggtcccaggccacagatgttcctgatgcagtccttgggtctgtgtgtgctttggcctggctgccctgtgtcccctgtgctgattcaggtatccctgggaatgtagaaagtagaatattcatgaggaaacaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattac

SEQ ID NO: 94354 - DNA, 3599 bp, Homo sapiens
  misc_feature (15)..(15): n is a, c, g, or t
agcgggggcgcagcngggagacagatgcgaggcggcggtcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtttcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctggacagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 94355 - DNA, 3583 bp, Homo sapiens
cctagctttcctccaagaggaagctcttcagaaggaagtgaagtgacataacaaaaaagcatctggatttctcaaagaaggaagttgtcttttgaaaagcaactttcaaacattaggttttcagaggtctgtgggcaggcaggtcaggctaggagcacgcagcaccgggtggaccttgaccgtgctgccacctttcctgccctggagcaagtcctcggtgccctctgggttgagtttccttctctgggtgaggggtgtcggggtctgctctgggcctgtctcggcggatgggccttaacagggagctcctgcaggatgggcctttgactgcccccgcccccaacctgggcagggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtttcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctggacagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 94356 - DNA, 3593 bp, Homo sapiens
ggagtcagatgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcaggacctcctggacgtgcatgccggccgcctgggctgctcgctcaccgagatccacacgctcttcgccaagcacatcaagctggactgcgaggtgggcctctgcccgagggccgctcttctccaaccccagccctgaggggggattggcaggagaagcagcccagcccagtgtgtccctggcctcagagtgcccagaggagctggcactgacgtgcccgtgccccaaccccacactgttccccccagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtttcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctggacagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 94357 - DNA, 355 bp, Homo sapiens
gacgcttggggggattcagtgctggagtttcctgtgcagagagccccgacctctttctgcccccagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcgg

SEQ ID NO: 94358 - DNA, 331 bp, Homo sapiens
aagtagttttgctggcctgtggcttccctggcttcattctgtatagtgtcattccttgtctggtttcttttatgctggctctacggctctacccaggtttgttggctgctccttgacagctgcccaagctcaccctcccaggtgttgacgccccttctctctgcatttccttgtccctgtgctctgcctgcctctgtatctgcattggtccatgtgtctctttgacgagccatctctctccctgtcctgcccctgcttgctcttgccggtgccccacatggtgtttgctatgaagtgggcccacagttcgtgcttactgaatgcatttata

SEQ ID NO: 94359 - DNA, 910 bp, Homo sapiens
  misc_feature (52)..(52): n is a, c, g, or t
  misc_feature (57)..(57): n is a, c, g, or t
  misc_feature (61)..(61): n is a, c, g, or t
  misc_feature (97)..(97): n is a, c, g, or t
  misc_feature (102)..(102): n is a, c, g, or t
  misc_feature (121)..(121): n is a, c, g, or t
  misc_feature (124)..(124): n is a, c, g, or t
  misc_feature (139)..(139): n is a, c, g, or t
  misc_feature (147)..(147): n is a, c, g, or t
  misc_feature (151)..(151): n is a, c, g, or t
  misc_feature (155)..(155): n is a, c, g, or t
  misc_feature (181)..(181): n is a, c, g, or t
  misc_feature (191)..(191): n is a, c, g, or t
  misc_feature (246)..(246): n is a, c, g, or t
  misc_feature (248)..(248): n is a, c, g, or t
  misc_feature (272)..(273): n is a, c, g, or t
  misc_feature (325)..(325): n is a, c, g, or t
  misc_feature (333)..(333): n is a, c, g, or t
  misc_feature (342)..(342): n is a, c, g, or t
  misc_feature (353)..(353): n is a, c, g, or t
  misc_feature (357)..(357): n is a, c, g, or t
  misc_feature (408)..(408): n is a, c, g, or t
  misc_feature (419)..(421): n is a, c, g, or t
  misc_feature (501)..(501): n is a, c, g, or t
  misc_feature (741)..(741): n is a, c, g, or t
  misc_feature (750)..(750): n is a, c, g, or t
  misc_feature (825)..(825): n is a, c, g, or t
  misc_feature (833)..(833): n is a, c, g, or t
  misc_feature (849)..(849): n is a, c, g, or t
  misc_feature (902)..(902): n is a, c, g, or t
agtagagacgggtttcaccgtgttagccaggatggtctcgatctcctgaccncgtgntctncccctcttggcctcccaaagtgctgggattacaggngtganccaccgcgcccggtcttgnagnacggttctgagtctntggaatanctgncatnaagtaacctgaaggaggtgctggctngtaggggttnattacatggttgggcacagctcgtacacttgccattctctgcatatgctggttantnaagtgagcctggcactcttctttnngctgagctaaagctacatacgatggttttgtggccacagttctaccgttcanttctgtanctgctttantggcttcttcngggnaggagaaacatacgaaaccaaaccctttgctgtgaccaccctccatcatancctttgcactnnngattgtaccaaatggagaaaactctttctggagacgttcatcatcaatactatcatcaagatttttcacgtaaatattancaccctggtatctgctggctgcagctactcctgctgtccgcaccgttccacagtataaatatgctgcgggagttcgcaatcctcagcaacatcttaatgcacagccacaagttacaatgcaacagcctgctgttcatgtacaaggtcaggaacctttgactgcttccatgttggcatctgcccctcaagagcaaaagcaaatgttcatatgctcgagagtccagagtcactctgttctanggttcatgnagctagctatattacaagcccaccaagctaaagaggctacccagaaagcagttaacagtgccattggtgttcctnctgtttanaattgatcagagaccncgaaaagaaacttgtgcttcaccaaagaaaaatatctaaacatcgaaaaactnaaatatgg

SEQ ID NO: 94360 - DNA, 827 bp, Homo sapiens
  misc_feature (52)..(52): n is a, c, g, or t
  misc_feature (57)..(57): n is a, c, g, or t
  misc_feature (61)..(61): n is a, c, g, or t
  misc_feature (97)..(97): n is a, c, g, or t
  misc_feature (102)..(102): n is a, c, g, or t
  misc_feature (121)..(121): n is a, c, g, or t
  misc_feature (124)..(124): n is a, c, g, or t
  misc_feature (139)..(139): n is a, c, g, or t
  misc_feature (147)..(147): n is a, c, g, or t
  misc_feature (151)..(151): n is a, c, g, or t
  misc_feature (155)..(155): n is a, c, g, or t
  misc_feature (181)..(181): n is a, c, g, or t
  misc_feature (191)..(191): n is a, c, g, or t
  misc_feature (246)..(246): n is a, c, g, or t
  misc_feature (248)..(248): n is a, c, g, or t
  misc_feature (272)..(273): n is a, c, g, or t
  misc_feature (325)..(325): n is a, c, g, or t
  misc_feature (333)..(333): n is a, c, g, or t
  misc_feature (342)..(342): n is a, c, g, or t
  misc_feature (353)..(353): n is a, c, g, or t
  misc_feature (357)..(357): n is a, c, g, or t
  misc_feature (408)..(408): n is a, c, g, or t
  misc_feature (419)..(421): n is a, c, g, or t
  misc_feature (501)..(501): n is a, c, g, or t
agtagagacgggtttcaccgtgttagccaggatggtctcgatctcctgaccncgtgntctncccctcttggcctcccaaagtgctgggattacaggngtganccaccgcgcccggtcttgnagnacggttctgagtctntggaatanctgncatnaagtaacctgaaggaggtgctggctngtaggggttnattacatggttgggcacagctcgtacacttgccattctctgcatatgctggttantnaagtgagcctggcactcttctttnngctgagctaaagctacatacgatggttttgtggccacagttctaccgttcanttctgtanctgctttantggcttcttcngggnaggagaaacatacgaaaccaaaccctttgctgtgaccaccctccatcatancctttgcactnnngattgtaccaaatggagaaaactctttctggagacgttcatcatcaatactatcatcaagatttttcacgtaaatattancaccctggtatctgctggctgcagctactcctgctgtccgcaccgttccacagtataaatatgctgcgggagttcgcaatcctcagcaacatcttaatgcacagccacaagttacaatgcaacagcctgctgttcatgtacaaggtcaggaacctttgactgcttccatgttggcatctgcccctcctcaagacataagcataatgttgggtgtacggctgtttcccctgattcaagccccccaccctactcttgctggtaaaatcactggcatgttcgttggagattgataattcagaacttcttcatagtatcgagtctgcaga

SEQ ID NO: 94361 - DNA, 340 bp, Homo sapiens
gcacactcacactcatatacacacccaggcacacacactcatacaccaagatacacacccacacactcatacacagacatacagacacacacaccagatatgcacactcacacatacactcagacacactcacatacactctctcacacacatactcctgggagggatcctgacattcacctaggggagtcaggggctacaggccttgacaagcatgctaacaatttccagtgtgggtaacagacctgggtcctggtctcccaccttttaaacctcagatgctccagcctgtaatccctactacctgggtttgaatcccagctctgttacttaccattta

SEQ ID NO: 94362 - DNA, 473 bp, Homo sapiens
ctgtcaaatgggaatgtgagcatttgccgtgattccttagggagaatgaatgtgaggctctgcctggcacaaagttccctgcctggcagagtgaggtcgaccactgggtgctgaggatgatgatgtggtagtcattcagcccttgctgcctgccgttctttgtggcttcctgatactctaactctggggttctcaactgccccctagggacattggcagtgtctggagactttttggttgtcacaacctggggcatggaggaagtgcctaccccgtaggcgtctagtaggtagaggccagggatgcaactcaacagcctgccatgcccagaacagcccaccccacaaagaagtgtctccttcctaaggtcaggcaggtggaggttgaggaaccctgatttaactcaatccaggccccagacacccccctctccaacttgctccctgcataattactcacatgaggctaaatag

SEQ ID NO: 94363 - DNA, 1374 bp, Homo sapiens
atgtgctctgcctaagacctaggagaattagcagaaaaaataattaccatccttcccatgatacaatacaatgttattttccatttttccattctgcattcaatgagtatttaataataaaaatcacttccaatatagagtactatgttagacccagtgaaggttgctaaggtataaaacttccaatcctttctcaagcagtttattttaaaataataatgattatagtaaacatgtattgaaacttaactatgtgcctgcagttatgctgacatacttaggcacaccacatgcattacctcatttaacacaataactttattacgtggcattgttataactgttttttgtttttttgagacagagtctcgcactgtcacccaggctggagtgcagtgacgtgatctcggtcaagcgatcctcctgcctcagcctcccaaagtgttgagattacaggtgtgagccaccacacctggctaaatattgcaatcctaaaaataatgggaatcctgagttgaacactgtaacttcctaacatgttcaagataacattcatttattcagttaacaattttttattgagggattactatgtactacttattattttaagagattgaggatatagcagtaaacaatataaagtttttgccctcatacctatactctagactctgaagaattctcatacctttctctttatcactgcaaaagggcctttattaactttttaaacttgtatatccattcatcatttcacctgcaaatattttatcataatattttatattactttattgtaaagattttgaaaacatatttttaagggcagcatttgttcctctaaagattataagatgtaatttgtctgctttcccaaggaaaagcattttcctttgtaaaaatcaccttacattaatgatttcttggatctcacactctattgtagtatttctgtagctaaacaattataacatggtggagagtatactataataaagttatgtataaagtctcatgggaacagatgtaagaaaaattaactgcctaggcagtttctgaggaaagataaagaaaatagagccgacatttgtctcgtggatgaaaaaagagtaagtaggcattgaccaggttaacacaagaagaggatgttctatgcccagctgacttttgtatttttcatagaaacagggtttcgccatgttggccaaggctggtctcgaactcctggcctcatagcatccgcctgctcggcctccctaagtgctaggaatacggacatgtaccaccgcacccatgcctataagctgtttgtataaatgtaattaatacccaagttaagtattatagttcagtccactcaatgtagctccc

SEQ ID NO: 94364 - DNA, 789 bp, Homo sapiens
aagtgtgtcgtcgatcgcgtatgataaggagagtggaagagttttggagagaatataaagtttttgccctcatacctatactctagactctgaagaattctcatacctttctctttatcactgcaaaagggcctttattaactttttaaacttgtatatccattcatcatttcacctgcaaatattttatcataatattttatattactttattgtaaagattttgaaaacatatttttaagggcagcatttgttcctctaaagattataagatgtaatttgtctgctttcccaaggaaaagcattttcctttgtaaaaatcaccttacattaatgatttcttggatctcacactctattgtagtatttctgtagctaaacaattataacatggtggagagtatactataataaagttatgtataaagtctcatgggaacagatgtaagaaaaattaactgcctaggcagtttctgaggaaagataaagaaaatagagccgacatttgtctcgtggatgaaaaaagagtaagtaggcattgaccaggttaacacaagaagaggatgttctatgcccagctgacttttgtatttttcatagaaacagggtttcgccatgttggccaaggctggtctcgaactcctggcctcatagcatccgcctgctcggcctccctaagtgctaggaatacggacatgtaccaccgcacccatgcctataagctgtttgtataaatgtaattaatacccaagttaagtattatagttcagtccactcaatgtagctccc

SEQ ID NO: 94365 - DNA, 567 bp, Homo sapiens
ttttgccctcatacctatactctagactctgaagaattctcatacctttctctttatcactgcaaaagggcctttattaactttttaaacttgtatatccattcatcatttcacctgcaaatattttatcataatattttatattactttattgtaaagattttgaaaacatatttttaagggcagcatttgttcctctaaagattataagatgtaatttgtctgctttcccaaggaaaagcattttcctttgtaaaaatcaccttacattaatgatttcttggatctcacactctattgtagtatttctgtagctaaacaattataacatggtggagagtatactataataaagttatgtataaagtctcatgggaacagatgtaagaaaaattaactgcctaggcagtttctgaggaaagataaagaaaatagagccgacatttgtctcgtggatgaaaaaagagtaagtaggcattgaccaggttaacacaagaagaggatgttctaggcaatatagaattattaagaagatggccgggtgcggtagctcacgcctgtaatcct

SEQ ID NO: 94366 - DNA, 3908 bp, Homo sapiens
  misc_feature (3776)..(3776): n is a, c, g, or t
  misc_feature (3820)..(3820): n is a, c, g, or t
agccgggctgtcggggcgaccgcgggagctcgccgtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactctcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcgcgcgccacatttggctaaattttgtatttttttgtagagatggggtttcgccatgttgcccaggctgtttttcttaagataaatacatttttaaaaaaagaaatagatcactttggtaaatctccgtactgtttttatagaggttgtactaatttacattcccaccagcagcanataagtgttcctttttcgccatatccacaccaacatctattgtnttttgactttttaataatggccattctggctggggtaaggtttatctccatgtggtttaatttgatttctctgatgatagtgatgtgg

SEQ ID NO: 94367 - DNA, 3857 bp, Homo sapiens
agccgggctgtcggggcgaccgcgggagctcgccgtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactctcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcgcgcgcatatatacacatatatgtatacatacacacgtatatatacacatatatgtatacatacacacgtatatatacacatatatgtatacatacacacgtatatatacacatatatgtatacatacatacgtatatatacacatatatgtatacatacatacgtatatatacacatatatgtatacatatatatgaacacatatatatgtgtgtatatatatatatataagattttacttgaccatgaatcaca

SEQ ID NO: 94368 - DNA, 587 bp, Homo sapiens
ctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtgctcgcagccctgggttccagagcccacatttccctgtcctcccatctctattttgcctctaatcctccgtgaccttcccctctgtctcccaagttgcatagctcattggacgacttctccagcttagcttcctgcctttctcttgtgcccagacactaccagtaaatgaccagtgtgagttgcatgtgtgggtcagaggccttcctttgtgcaacacccccagcttccctcaccatgactctactgaacatggggttcaatacagtgctccgcaaggatttagtgaacaccatggtaggagctcacttctagcagcctgggaacttgcccttgaaaagtaaactgcaacaaggcgaggcaaaaaaacaaagcagagattaccattacaaaacgctatctcatgtttcatgttggtaactcttaaaaatgccatta

SEQ ID NO: 94369 - DNA, 4750 bp, Homo sapiens
agccgggctgtcggggcgaccgcgggagctcgccgtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactctcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccacctaaccacagcgcctctccagacctacctcgggacctaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggaagggactcaaagcagcaatgcccctcatagtgtaggctaaggtgagtttggtgcatgcaaacctgtgtgctcacccacagagcatggggtaatggtgtgtagacacaggccctctgcagaagcgtggggtggggacactgacagcccctatctggtccccaggaacattctaccatttctgccactggtgttcagctccttctcttcccccaacactcccaaagatacccacaggaagtccagccagtttccaggtagaggattccaccagttggtcttgggctgcgttcaccctcacatcacagcaccttaaatctaatcagcaaactataatttgtacgttgaaacctgcaacacattagaaacttatatttaaaaacagaattaatcacactgaccaacttttaaatggaaaatatgtaaataggaagtgtttgggttttgttttttctttaagaaaaagaaatgtacaccactcctcatgtgccattttgtcctcagagggcggctttacttttttggtaaaggaacaagctgctggccttgaccaggagttcatatataactgttattacagaggaattgttataactactaatgtttttaaaaaatttattaaacattattaaacttgatcaggtcaggccaaataaagttttattggaacacagaaaaaaaaa

SEQ ID NO: 94370 - DNA, 3731 bp, Homo sapiens
agccgggctgtcggggcgaccgcgggagctcgccgtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactctcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcgcgcgccacatttggctaaattttgtatttttttgtagagatggggtttcgccatgttgcccaggctgatggtcccaaaactcctgagctcaagcgattctcccgcctcggcctcccaaagtgctgggat

SEQ ID NO: 94371 - DNA, 3017 bp, Homo sapiens
acccgttgcctgatgacgagagttgggagtgtggctggggctgcggatctccagcagtggcgttacttctagcggctggataccgggttctccgcgagatcccgagatattctccccgcacggaagcgacgactggcctggccagaggactcgcgtgggagcgaggtgccggccccgacaggacggtgagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgatggagtctcatgctggagtgagtctcaccaggctggagcgcagtggtgcgatctcggctcactgcaacctccacctcccaggttcaagcgattcgcctgcttcagcctcctgagtagcagagactacaggcgcgtgccaccacgcccagctaattttgtatttttagtagagacggggtttcaccatgttggccaggatggtctccgtctcttgacctcgtgatccgcctgcctcagcttcccaaagtgctgggtttttttttgttgttgttgttgttttaacattctgtatctcttagctgacattggaaatctgacctgtaattttcaaaagtgtcaaagtcatgaaatataaggaaagactgaaaagctgttctatatcgaagaaaactaaaatacacattaaagttcaatgcaatgtgtgattctaaagtggatccttttgctatagaggacattatttatacaactgtcaaaattttaagtctaaggattaaatattagaaataaatcagtattaatgtcctgatcttgatggttgtattatggttatttatataggaggatttccttcactggaggaaatataagtatttggagaggatggggtattatgtttgcaaatatttcagggaaaaaaagttgtttttcctgttattgcaacttttctgtatgttttcaactgtttcaaataaaattaaaaaccacatgcctaggaataaatctgatagacaagatttctatgaagaagcaataaagcattgagagagatttttaaaagacctaagtaaatagagggaaatagcatgttcatagattgggagactcattattttaaagatgtcagttatctccaaactgatctacatgtcccatgcaataccagtcaaaatcccaattgtgatttttttatagaaattgacaaggtactttaaaaatgcatatggaaatgccaacgacctcttaaaaggacaaaaaaattgtaagagttactagctcttaaaccttaataaagttatagtaatatatggcattgctgaaaggaaacaggaatggaatagaacagagagcttagaaacagacctatgcatatatggtcattatgacaaaggtggaactgcaagagaaagttaaagatggtcttttcagtaaataatactggaataattggatttccatatggaaaaagtgaaatctcaccccaaccttatgcacaaaagtccattttaaatgggttatggatataaaaatgaaaggtaaaacaataagacttctagaaaataatacaagaaaatatcttcataatattaaaatctggaaaggcttaaacagaacagaaaataccctaaaccataaagagaaagactgataaatttgactacgatacaattaaaaacctcagttcatcaaaaaataaaacgaggcaaacaatagattgggagaatatattaatatttgcaatacataactgacaaatagatcatttctggaatacataaagcatttctgaaagtaataagaaaagacaaacaacccagtaggaaaatgggcaagagacttgaatgggcacttaataaaaaatgatattcacatggccaataaacatatgagataatatcaaccttatcatgaagtcttgttgtgattttaatttgctattccctgattgttaatgaggctgagttctgtttcacagaaaccttgcaaggttaaatttaacttatactaaggaatggtgagcatatggagcaaacagaaactttgtgacctgctggtgggtgtgtaaattggtataatcattttggatgatagcttggcgttatttactgaaattgatacatgccctgcaacctagaatttttactcccagttgtatacctaaaactgatgtgagcacaggtgctctaagcaacatgtataaagctgttcatagcaccatttttcttaatagccccaaactgaaacagcccaaatgtccattataaatagaaattgataaattgtaacattttgtacaatattatatatcaatgaaataagcaaattacagcagtatgccacaatgtggattgatttcatgaatatacgtgaaaaacagcacagaagaataccatacactatgtgattttaattttataaagttcaaatataggcaaagcaaagcaatagttttatttacacttctgtagataaaaactgtattatacacatgcatatatatgaatgcttaggtggtaaaattataaaggagagtaaagaaatgactgcattatattaagactaatggctacttttcaaagggagggagaggctggtgatgggaaaggggcatgagtggagtatgtaaggtgcttgcaatgtaatatttcttggcctatgtggtgtttgctttgtgataaatcagtaagctgtagttctttgtttttgcacttttcataagtataatacctaataaacatttaaatatttgc

SEQ ID NO: 94372 - DNA, 1347 bp, Homo sapiens
  misc_feature (90)..(90): n is a, c, g, or t
atcatagtagaaccaccgtgttctaaccttattgtgtatcaccataacagtttattgtggctctgatgtcataaaggaagagacatggangaagaaaaagggggaaaaacgtagtatttaaaattctttagtctttttctactacataggctgcgagatttccttcaaattttattaaagtataaattatgtatgtaaactaatgtcccgaaataagctcttaaagcttactttagctatttaaaggatttatggctttctgtgtttttctttttgttaatttaatttttttttttttcttgagccagagtttgagatcgctcttgttgctcaagctggagtgcaatggcgcgatctcggctcactgcaacctctgcctcctgggttcaaacgattctgcctcagccacccgagtagctgggattacaggcatgtgccaccatgcctggctaattttttttgtatttttagtagaaacggggtttcaccatgttagccaggctggtctcaaacttctgacctcaggtgatccacccgccttggcctcccaaagtgctgggattacaggcatgagccgccacgcccggccaattttattcttaatttaaatagttttcccgggtttatcaagaatctttaaactttattccttccataaagtcattattatgaccacacccagtggaagaggaggaatgaaagatgcaaactttaaggtttcaggatatttgaagtgttgggtgcattgagaccagtagctgataataatcctttaattttctcgtttattaaaggttaaagacatatactcaatcccaagtactaaaatagatgtaaaaaaattctggatttgaaaactgttggtttttaaaagagaaatatttttaaattcttattttaggatgaggatatgttcatgaaatttgtaagtgaagatcttcatcggtgtgcacttttaacaggtttgaacctattcatatagtttttgtttagcataaaactttgaatggataaaaaagaagatgaggaaactaaaaagtcagattgaataatatagggaatgattattctagtagattgtgaaagagaactgtatctacttgcagagttcaaacttttcaggtttgttttaggtaagcctattttatattagaaaataataaatgaaagtggtgattatcttatatttaacataaggatttaccttgtcatttgtttaaatgtattgactgtatgactcaagttataacggacagattatgttagaagtacatcttcatttaaacgaagtacattgtctaaagagtctcattaataaagtcattcatttgcaactgaaaaaatgtg

SEQ ID NO: 94373 - DNA, 1293 bp, Homo sapiens
  misc_feature (90)..(90): n is a, c, g, or t
atcatagtagaaccaccgtgttctaaccttattgtgtatcaccataacagtttattgtggctctgatgtcataaaggaagagacatggangaagaaaaagggggaaaaacgtagtatttaaaattctttagtctttttctactacataggctgcgagatttccttcaaattttattaaagtataaattatgtatgtaaactaatgtcccgaaataagctcttaaagcttactttagctatttaaaggatttatggctttctgtgtttttctttttgttaatttaatttttttttttttcttgagccagagtttgagatcgctcttgttgctcaagctggagtgcaatggcgcgatctcggctcactgcaacctctgcctcctgggttcaaacgattctgcctcagccacccgagtagctgggattacaggcatgtgccaccatgcctggctaattttttttgtatttttagtagaaacggggtttcaccatgttagccaggctggtctcaaacttctgacctcaggtgatccacccgccttggcctcccaaagtgctgggattacaggcatgagccgccacgcccggccaattttattcttaatttaaatagttttcccgggtttatcaagaatctttaaactttattccttccataaagtcattattatgaccacacccagtggaagaggaggaatgaaagatgcaaactttaaggtttcaggatatttgaagtgttgggtgcattgagaccagtagctgataataatcctttaattttctcgtttattaaaggttaaagacatatactcaatcccaagtactaaaatagatgtaaaaaaattctggatttgaaaactgttggtttttaaaagagaaatatttttaaattcttattttaggatgaggatatgttcatgaaatttgtaagtgaagatcttcatcggtgtgcacttttaacaggtttgaacctattcatatagtttttgtttagcataaaactttgaatggataaaaaagaagatgaggaaactaaaaagtcagattgaataatatagggaatgattattctagtagattgtgaaagagaactgtatctacttgcagagttcaaacttttcaggtttgttttaggtaagcctattttatattaggtcatttgtttaaatgtattgactgtatgactcaagttataacggacagattatgttagaagtacatcttcatttaaacgaagtacattgtctaaagagtctcattaataaagtcattcatttgcaactgaaaaaatgtg

SEQ ID NO: 94374 - DNA, 600 bp, Homo sapiens
acccgttgcctgatgacgagagttgggagtgtggctggggctgcggatctccagcagtggcgttacttctagcggctggataccgggttctccgcgagatcccgagatattctccccgcacggaagcgacgactggcctggccagaggactcgcgtgggagcgaggtgccggccccgacaggacggtgagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagattggactccttcttgtcctgagccagtgtatatcccaacgggcttagaaacggaacccctttatccagactccaaggaagctactgtggtttatctagctgaagatggtgagcacataatgacacatgttgctgtaaaatataatttggtacttaggttaatctcttaattatatttgttttgctgtttgtagtggaaatttcagatgaccagtccctaaacataaagatgtttgtttat

SEQ ID NO: 94375 - DNA, 3566 bp, Homo sapiens
  misc_feature (90)..(90): n is a, c, g, or t
atcatagtagaaccaccgtgttctaaccttattgtgtatcaccataacagtttattgtggctctgatgtcataaaggaagagacatggangaagaaaaagggggaaaaacgtagtatttaaaattctttagtctttttctactacataggctgcgagatttccttcaaattttattaaagtataaattatgtatgtaaactaatgtcccgaaataagctcttaaagcttactttagctatttaaaggatttatggctttctgtgtttttctttttgttaatttaatttttttttttttcttgagccagagtttgagatcgctcttgttgctcaagctggagtgcaatggcgcgatctcggctcactgcaacctctgcctcctgggttcaaacgattctgcctcagccacccgagtagctgggattacaggcatgtgccaccatgcctggctaattttttttgtatttttagtagaaacggggtttcaccatgttagccaggctggtctcaaacttctgacctcaggtgatccacccgccttggcctcccaaagtgctgggattacaggcatgagccgccacgcccggccaattttattcttaatttaaatagttttcccgggtttatcaagaatctttaaactttattccttccataaagtcattattatgaccacacccagtggaagaggaggaatgaaagatgcaaactttaaggtttcaggatatttgaagtgttgggtgcattgagaccagtagctgataataatcctttaattttctcgtttattaaaggttaaagacatatactcaatcccaagtactaaaatagatgtaaaaaaattctggatttgaaaactgttggtttttttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgatggagtctcatgctggagtgagtctcaccaggctggagcgcagtggtgcgatctcggctcactgcaacctccacctcccaggttcaagcgattcgcctgcttcagcctcctgagtagcagagactacaggcgcgtgccaccacgcccagctaattttgtatttttagtagagacggggtttcaccatgttggccaggatggtctccgtctcttgacctcgtgatccgcctgcctcagcttcccaaagtgctgggtttttttttgttgttgttgttgttttaacattctgtatctcttagctgacattggaaatctgacctgtaattttcaaaagtgtcaaagtcatgaaatataaggaaagactgaaaagctgttctatatcgaagaaaactaaaatacacattaaagttcaatgcaatgtgtgattctaaagtggatccttttgctatagaggacattatttatacaactgtcaaaattttaagtctaaggattaaatattagaaataaatcagtattaatgtcctgatcttgatggttgtattatggttatttatataggaggatttccttcactggaggaaatataagtatttggagaggatggggtattatgtttgcaaatatttcagggaaaaaaagttgtttttcctgttattgcaacttttctgtatgttttcaactgtttcaaataaaattaaaaaccacatgcctaggaataaatctgatagacaagatttctatgaagaagcaataaagcattgagagagatttttaaaagacctaagtaaatagagggaaatagcatgttcatagattgggagactcattattttaaagatgtcagttatctccaaactgatctacatgtcccatgcaataccagtcaaaatcccaattgtgatttttttatagaaattgacaaggtactttaaaaatgcatatggaaatgccaacgacctcttaaaaggacaaaaaaattgtaagagttactagctcttaaaccttaataaagttatagtaatatatggcattgctgaaaggaaacaggaatggaatagaacagagagcttagaaacagacctatgcatatatggtcattatgacaaaggtggaactgcaagagaaagttaaagatggtcttttcagtaaataatactggaataattggatttccatatggaaaaagtgaaatctcaccccaaccttatgcacaaaagtccattttaaatgggttatggatataaaaatgaaaggtaaaacaataagacttctagaaaataatacaagaaaatatcttcataatattaaaatctggaaaggcttaaacagaacagaaaataccctaaaccataaagagaaagactgataaatttgactacgatacaattaaaaacctcagttcatcaaaaaataaaacgaggcaaacaatagattgggagaatatattaatatttgcaatacataactgacaaatagatcatttctggaatacataaagcatttctgaaagtaataagaaaagacaaacaacccagtaggaaaatgggcaagagacttgaatgggcacttaataaaaaatgatattcacatggccaataaacatatgagataatatcaaccttatcatgaagtcttgttgtgattttaatttgctattccctgattgttaatgaggctgagttctgtttcacagaaaccttgcaaggttaaatttaacttatactaaggaatggtgagcatatggagcaaacagaaactttgtgacctgctggtgggtgtgtaaattggtataatcattttggatgatagcttggcgttatttactgaaattgatacatgccctgcaacctagaatttttactcccagttgtatacctaaaactgatgtgagcacaggtgctctaagcaacatgtataaagctgttcatagcaccatttttcttaatagccccaaactgaaacagcccaaatgtccattataaatagaaattgataaattgtaacattttgtacaatattatatatcaatgaaataagcaaattacagcagtatgccacaatgtggattgatttcatgaatatacgtgaaaaacagcacagaagaataccatacactatgtgattttaattttataaagttcaaatataggcaaagcaaagcaatagttttatttacacttctgtagataaaaactgtattatacacatgcatatatatgaatgcttaggtggtaaaattataaaggagagtaaagaaatgactgcattatattaagactaatggctacttttcaaagggagggagaggctggtgatgggaaaggggcatgagtggagtatgtaaggtgcttgcaatgtaatatttcttggcctatgtggtgtttgctttgtgataaatcagtaagctgtagttctttgtttttgcacttttcataagtataatacctaataaacatttaaatatttgc

SEQ ID NO: 94376 - DNA, 4203 bp, Homo sapiens
acccgttgcctgatgacgagagttgggagtgtggctggggctgcggatctccagcagtggcgttacttctagcggctggataccgggttctccgcgagatcccgagatattctccccgcacggaagcgacgactggcctggccagaggactcgcgtgggagcgaggtgccggccccgacaggacggtgaggtatgcagaagtaaggcggggcgccccctgcgggaagcgagcgcgccccggaaaatgagcgcctccccacaccaaggtgtccaggagtgagtgcgggaaggaactcggccgcccggagttgtggcctcatcgtgcttcccgccaaaaacgccttggtactgtcgggacgcggctaagcgtggacgcgcccgcatctgcccctcctccgcagtggtggaagacacccgcggagcgccggtggataagggccgtttcctgagaccagagctgtatccgcagcaggtcagcacttcgtgcgccctgtgtgcacctgtaaggaatggaatttaggccagtcggattttccaaatgtggagttgtgatgcccaggcagaaacttcagtttcttaggactgaaggtgtcatctatgagacagtcggttccgtggcattggcagtgatttgccatagagcttggacttaacttatatgtagtccacgctccaaaacacgcttcctgtagagaggggcgtaaactaatagatttgaaattgtcgagtcctttggtctctcaagaacgatgggaacttgacaagaaatttcgattattccctggtcttgatattacccacatgggaagatacttgcatagaatggtaatggtcattaccaatacaaccttctggtagctatttagatttctaagaataagaataatataaatgaatattagaacagacagtatctacagaataataatcaaaatgtaaagtcttgtcacttgaacttttggtcaagtgaaaatcaaggagaaaacttaaaattatattgctacatttcagtaagtgactataatttttaaattcattatcttttaatgcctcaggatcattctgaacttgctgtgtagtatttaattgtaaatataaaatgtgaatgatttggctgtatactctggaaattccttttaattaaatgatttgcttgattgtcttattgtggttgttgtctcgtatagtcatggaaaattcctttaactctttgaaattgaaggttttattagttgtattctaattagtttttagagaagactgttgtgactgttaaatacaattgaatatatttttgagtactcatttaatgtagtaaacacctacagcttgaaaagaaaagctgtcatataatttccttagaaattgttttacagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgatggagtctcatgctggagtgagtctcaccaggctggagcgcagtggtgcgatctcggctcactgcaacctccacctcccaggttcaagcgattcgcctgcttcagcctcctgagtagcagagactacaggcgcgtgccaccacgcccagctaattttgtatttttagtagagacggggtttcaccatgttggccaggatggtctccgtctcttgacctcgtgatccgcctgcctcagcttcccaaagtgctgggtttttttttgttgttgttgttgttttaacattctgtatctcttagctgacattggaaatctgacctgtaattttcaaaagtgtcaaagtcatgaaatataaggaaagactgaaaagctgttctatatcgaagaaaactaaaatacacattaaagttcaatgcaatgtgtgattctaaagtggatccttttgctatagaggacattatttatacaactgtcaaaattttaagtctaaggattaaatattagaaataaatcagtattaatgtcctgatcttgatggttgtattatggttatttatataggaggatttccttcactggaggaaatataagtatttggagaggatggggtattatgtttgcaaatatttcagggaaaaaaagttgtttttcctgttattgcaacttttctgtatgttttcaactgtttcaaataaaattaaaaaccacatgcctaggaataaatctgatagacaagatttctatgaagaagcaataaagcattgagagagatttttaaaagacctaagtaaatagagggaaatagcatgttcatagattgggagactcattattttaaagatgtcagttatctccaaactgatctacatgtcccatgcaataccagtcaaaatcccaattgtgatttttttatagaaattgacaaggtactttaaaaatgcatatggaaatgccaacgacctcttaaaaggacaaaaaaattgtaagagttactagctcttaaaccttaataaagttatagtaatatatggcattgctgaaaggaaacaggaatggaatagaacagagagcttagaaacagacctatgcatatatggtcattatgacaaaggtggaactgcaagagaaagttaaagatggtcttttcagtaaataatactggaataattggatttccatatggaaaaagtgaaatctcaccccaaccttatgcacaaaagtccattttaaatgggttatggatataaaaatgaaaggtaaaacaataagacttctagaaaataatacaagaaaatatcttcataatattaaaatctggaaaggcttaaacagaacagaaaataccctaaaccataaagagaaagactgataaatttgactacgatacaattaaaaacctcagttcatcaaaaaataaaacgaggcaaacaatagattgggagaatatattaatatttgcaatacataactgacaaatagatcatttctggaatacataaagcatttctgaaagtaataagaaaagacaaacaacccagtaggaaaatgggcaagagacttgaatgggcacttaataaaaaatgatattcacatggccaataaacatatgagataatatcaaccttatcatgaagtcttgttgtgattttaatttgctattccctgattgttaatgaggctgagttctgtttcacagaaaccttgcaaggttaaatttaacttatactaaggaatggtgagcatatggagcaaacagaaactttgtgacctgctggtgggtgtgtaaattggtataatcattttggatgatagcttggcgttatttactgaaattgatacatgccctgcaacctagaatttttactcccagttgtatacctaaaactgatgtgagcacaggtgctctaagcaacatgtataaagctgttcatagcaccatttttcttaatagccccaaactgaaacagcccaaatgtccattataaatagaaattgataaattgtaacattttgtacaatattatatatcaatgaaataagcaaattacagcagtatgccacaatgtggattgatttcatgaatatacgtgaaaaacagcacagaagaataccatacactatgtgattttaattttataaagttcaaatataggcaaagcaaagcaatagttttatttacacttctgtagataaaaactgtattatacacatgcatatatatgaatgcttaggtggtaaaattataaaggagagtaaagaaatgactgcattatattaagactaatggctacttttcaaagggagggagaggctggtgatgggaaaggggcatgagtggagtatgtaaggtgcttgcaatgtaatatttcttggcctatgtggtgtttgctttgtgataaatcagtaagctgtagttctttgtttttgcacttttcataagtataatacctaataaacatttaaatatttgc

SEQ ID NO: 94377 - DNA, 1736 bp, Homo sapiens
acccgttgcctgatgacgagagttgggagtgtggctggggctgcggatctccagcagtggcgttacttctagcggctggataccgggttctccgcgagatcccgagatattctccccgcacggaagcgacgactggcctggccagaggactcgcgtgggagcgaggtgccggccccgacaggacggtgaggtatgcagaagtaaggcggggcgccccctgcgggaagcgagcgcgccccggaaaatgagcgcctccccacaccaaggtgtccaggagtgagtgcgggaaggaactcggccgcccggagttgtggcctcatcgtgcttcccgccaaaaacgccttggtactgtcgggacgcggctaagcgtggacgcgcccgcatctgcccctcctccgcagtggtggaagacacccgcggagcgccggtggataagggccgtttcctgagaccagagctgtatccgcagcaggtcagcacttcgtgcgccctgtgtgcacctgtaaggaatggaatttaggccagtcggattttccaaatgtggagttgtgatgcccaggcagaaacttcagtttcttaggactgaaggtgtcatctatgagacagtcggttccgtggcattggcagtgatttgccatagagcttggacttaacttatatgtagtccacgctccaaaacacgcttcctgtagagaggggcgtaaactaatagatttgaaattgtcgagtcctttggtctctcaagaacgatgggaacttgacaagaaatttcgattattccctggtcttgatattacccacatgggaagatacttgcatagaatggtaatggtcattaccaatacaaccttctggtagctatttagatttctaagaataagaataatataaatgaatattagaacagacagtatctacagaataataatcaaaatgtaaagtcttgtcacttgaacttttggtcaagtgaaaatcaaggagaaaacttaaaattatattgctacatttcagtaagtgactataatttttaaattcattatcttttaatgcctcaggatcattctgaacttgctgtgtagtatttaattgtaaatataaaatgtgaatgatttggctgtatactctggaaattccttttaattaaatgatttgcttgattgtcttattgtggttgttgtctcgtatagtcatggaaaattcctttaactctttgaaattgaaggttttattagttgtattctaattagtttttagagaagactgttgtgactgttaaatacaattgaatatatttttgagtactcatttaatgtagtaaacacctacagcttgaaaagaaaagctgtcatataatttccttagaaattgttttacagcctacccgtatattacaagaaatctcaagtcaaacactggaaaagatgtcagaagattcagaaaaggaagactattcagacagaacaatcagtgatgaagatgaatcggtatgtttttctcaactttattttacttggagataaaatttgtattatataaatccccaattaaaatattataaaatcaattggatataaaaatcaattggatgtttaaattattgtcattgaagttgggaaataatttggctgaaaaagctaagctatcactgggaacactatgccctgtctagaaagagaaactatatttgtattttttttgagaaaatattttagctaagattcttctaggttttatta

SEQ ID NO: 94378 - DNA, 437 bp, Homo sapiens
cctgggctcaagtgaccgtcccaccttggcctcctgaagtgttttgattacaggtatgagccactgcaccaggccagcatacatttcatttggccttattgtcttaaagatgtctttgggtgtcaggccccacgcatttaatgcggctttattgtcttgtaggtatccttgggtatgaagtcccatgcattcagtgcagccccgtattgtcccgggtgtctgagggtgtcaggcccgatgcgttcaacacagccttgcgttcagtgcagccccgtattgtcccgggtttctgagggtgtcaggtccgatgcgttcaaaacagccttgcgttcagtgcagccccgtattgtcccgggtgtctgagggtgtcaggtccgatgcgttcaacacagccttgcgttccctgcagccccgtattgtcccgggtgtctgagggt

SEQ ID NO: 94379 - DNA, 393 bp, Homo sapiens
ctttagaaaaaaagtgtttcagtgtttgaattaccatcctgtctttctttgaagagccaaatacagcttacatcatcttcaggtaaaacaaaatttagggttcagaaactatatggcataagaaaatagttgaactgggcacagtgtttcatgcctgtaattccagcactttgggaggccaaggtgggcagattgcttgagctcaggagttctttcagaccagccagggcaacgtggcaagaccttatctctaccaaaaatacaaatagctggtcatggtatgtgcctgtggtcccagctgaggccggcaggattgcctgagccctggaggtcaaggctacagtgagccaaaactgtgccactgcactccagcctgggcaacagagtgagatc

SEQ ID NO: 94380 - DNA, 527 bp, Homo sapiens
tcattaactgagggttttctgctgtatttggttccacacatgcaatttatatggcatttaatctgagagacccatctgcctcagtggcccatttcccttttatttttggttgctaagaaatgttttgtatctcctttgttccgggtagtctgtgctgttctaaatccttacaagcacttcagatttcgtacattggggttcggagtaagatcaaaaggactagctggttggtgtgaggaagaatgtctgggacctggcccattataatagtatatctggacttagattttgaactctaaagcatatgtacagttggaatggaacacttgtagaagtaacacaggtctatatatcaatggttactgcagctgtggtttctagatggtataggctgccccaacatgaacagggcataaagcgcaccatcactgtggggctgcgtgccacagcggaccacttcaaccacatggctctttacatgattgatgccactgaattagaataaaatctcaaatcttaatatcact

SEQ ID NO: 94381 - DNA, 405 bp, Homo sapiens
aaataaaattcaatttaaaattcaacctttactttcactattaaatagcaatgcaggtaaaaggctgagtggaaaagcattaaatagatattcatggtgaatagactgtgaatgatctgtaatcagaagtcaaactacagcttatgtcaatgcacactagacccatgaaagagttccattaaaaatgtatgtataattctgaaattttcatgttgcatgacatgaatagtctgataagagagttctatcgtggttggtatggagggttttgggaactgaaaggtgctcattatttaactacaatgatgaagcaatgccaactttcagtctttttttttacaaaaataagttatatttttgaataagtaatacattacaatgaagtatcaataatttaaataatgt

SEQ ID NO: 94382 - DNA, 525 bp, Homo sapiens
gtgggcctgagctcagagcacaagcctccgagttcactcgggcgtttgttatagctagagcttcattccttaaatccagccagggaactgggaagccttactttttctttcaagatcaaatacaggtgtgtggcagagataggtgtaaaattgacacgcacttttaagctgaaacttaagacttctatgatcttttggacttaggggtcccttgaggttggagccccatcctctaggagggccccattgtgtatttccttggtgagtctggggtgtggcctctgggggtcactctgcatgggcaggcctggcccagtggggctgaggcagttttggggtcggctgcctctgtgtgggtgcctggttatcctctgagcccacaatcgaaaaggcagctagttctgtattcatgaagcttaggaactctgtcttggaaaggatggttataactacactctctccaagacagagttcctaagtttatgaatacagaactagctgctttaaaaagaacagaaggacctg

SEQ ID NO: 94383 - DNA, 439 bp, Homo sapiens
agatgaggaaactgaagcctagagaggcaaggtaacttgccctaggttatgcacctaggaagctatgaggcctgcgttccaacccaggtcaaaagactccaaggctggcaacctctgtttcactgctgcctctggactgcttgcagggaccagttatgaaacatatttctcattgtggaagggttgggcaacaatttatttaaaagtgcagtgcatttataagtatcaaagaaagtaccaatatggccttaaagattcagatgataaaaagttatctgttttttaagaaaatgaggccgggtgcggtggctcacgcctataatcccagcactttgggaggccactttggtggattgcttgaggccaggagtttgagactagcctggccaacatggtgaaacccgtctctactaaaaatacaaaaattagctgagcatgg

SEQ ID NO: 94384 - DNA, 417 bp, Homo sapiens
gacaagctgtttactaagtggggtctgcctatttaggaaagttgagaaagttgcttgcaactcattttgtgagctgagggtcaccaagccaaaccacaaatccacactagaaaagagaaggccgtgactaatgtggataaaaggcagaaagattcaggctggccttggcaagtgttagttgaggaaaaaggagctggtttaaggctgggactcttcccagaaaatggcataatttacaagcttcatctgagaagagtgtttacagctatgggaaggtttgatgttacagttacagtgaaaaagctgggcaacatctgttcctcttctctgtaatgggcttgttttgaaaggtaggatttagcaagaaagatcaaagcaaaacaatggtctcctcacgttccataaagtgtatgcatt

SEQ ID NO: 94385 - DNA, 132 bp, Homo sapiens
atactcacacacacgctgccacatgctctgtctctcacacatacctgacagttccgtgctgtcccgtttccctcggggtcttcccttcggaggctgcagctcgtctgagcatccagccttgaaggcactgag

SEQ ID NO: 94386 - DNA, 349 bp, Homo sapiens
cacaatagggttcgcactcctgtgagaatctgttgccacagctgatctgataggaggtggagctcaggtggtaatgctcgctcacctgctgctcacctcttgctgcgtggcctggttcctaacagccaccatccgcggcccaggggtggggaccctgcacttggtaacagcacctcctatctctccatccctcagcacattggcagtaaccaagaatgtctctatgtgttgccaaatgtccagtgagggtggggagcacatcactactcctggttttgagtaccactgctcacagtaaaatcaaatgcagatacaggcattctacagctaatcattcagtgtaattatc

SEQ ID NO: 94387 - DNA, 197 bp, Homo sapiens
aactggaaatgtgagttttattatccctctatgaggaaatgagtcacaaagaaaccaaattctaagaggttccattttattcacaaaaattaaaaatgctgtaacagaaaactgattcaaattcctgtggcaaaaatcagatgaaatattaaaatttaagttcttaattggagagtacggacattgttggttacttc

SEQ ID NO: 94388 - DNA, 546 bp, Homo sapiens
tcacagatccctcaccccaaccccagaccctacgtagcacattgcctgcaaagatgctcaagacgtgttttgcaatgaacaagagaatgagcagcccgcctgctccgggctgctcacctgttctagccaccttcaccatgttggcctccagctcccgtcttcagctgagcacaggggcctgtcccaggattcttggaagcggcttcctaaggcatcatgcttttgtgttctccttctcttaccagcctttctttccctctcacgtttctctccctttctgaccatgagcagggctgcagtgcagctgctgatggtcaagatgaagatggggaatgtgccagtgaaaacctggcatgcggaggcctcacctcactcaccctctcctgtcccagcttcaaaatctttcagagcgactcatgctgccagagggtggaggagtggaccttgaaatgacaagtgacagttcctcagcagtagcatctcctgctttctcagcctggtgacctgacccggcagcacgcccactgggcacctgtgcccacctgg

SEQ ID NO: 94389 - DNA, 504 bp, Homo sapiens
ctcccagttgtggtcgcggactccagttgtcaggtcttgggggccgaggccccggtgagcccaaggccagggacggccagctcgagacgcggggtcgcaagttccccttattaatcccgattccctctcatctgcaaaaaaatccttccatgcaccacggttgtacaaaaatccctcccgtgaagcgggccccgcccccagggtgtaatcgctccagcgggaaaacgaggcctggagcgcttccagtccctcggtagagccacgtgctcaggattttcgggcgtgtgcttcgtgcacgctcatccagacgctgcagaaacctggttcctgctgggcaaaggtctgttctgggaggctggaatccacagactccttgtggggcctagggttttagtgggagaccgagctgctccaaagcccctctccacgctcaacccccgcccaacccagcgttccagccacactggcttttctgagggtcattaaacgcagtttctcaaccag

SEQ ID NO: 94390 - DNA, 778 bp, Homo sapiens
agcggcgttgggactttcacttctttgatatggtttgtctgtgtccccaaccaaatctcctcttgaattgtagctcccataattcctagatgttgtgggagggaccgagtgggagataattgaatcatgggggtggtttcccccatactgttctcatggtagtgaataagtctcactagatctgatggttttataaggggaaacccctttcacttggttgtcattctctcttgtctgttgccatgtaagatgtgccttttgccttccaccatgattgtgaggcctccccagccacatggaactgtgagttcattaaacctctttttctttataaattattcagtcttgggtatgtctttatcagcagtgtgaaaacagactaatacactgctatatcccccagggcctgggaaatacttgcacatagtaggtctacaaataagtatttgctgaatgaatgagtacatgtgttcatttaataaattttgtttcattctggcatttgatttggagttactgtatctatattctaaatttttacattttttcacaaagtagctgagtgttatgtttctataagaacaccaagaagatgatctttaatctttcttgcttaataaggcctccccagactctcagacctgtttcctaaactcaaggagactgtcagtctctaagtggagtctaaggaggctaaagtggctaacattgctacagggcagagtgccaaagggaacagggctacacagacagggcgcaccggagatatacagaggga

SEQ ID NO: 94391 - DNA, 333 bp, Homo sapiens
ggttctacaaacatttcccagaccccattgccaaatttcctgttagggtctgccaatgggataccctaaaggaacccttaaagataggagagacttcattcctgttttccagttgtcacatgatctcagctgcagacatctggcttctactagctagttctgcactcaacatcagctttgccacacttctcagagatatttgcagcagtctgactacccacttggcagtctgagatcagtcatcccttgctttcccaccctcagggccatgcctttcctcagaggtataagcaccaagatacctggagggagcttctcccataaaagtcagta

SEQ ID NO: 94392 - DNA, 376 bp, Homo sapiens
cgcgccgcgcccgccccgcgcgcccctgtactccccgcgccgctcctcggggtcccgcggcgctcgcaggccgcgccgccctgccgcccctctctcgtggcttttacggcccgcccgcccctcagcagccctggggtgcccggggcggccctgcaagcgggagagagcggcgaggcggcggcgccgagtgcggggggatgcggagccgtgcccggccctgtcgcatccctcggccgcccgcccgcgcccggccccgcccggccttgcccgggctgcacgcacttctcccgcggcccagaatccacttgaccctgctgggcgctcccgcgggcggcggacccgggtgggtgcgggggaattccccggccgcccaggc

SEQ ID NO: 94393 - DNA, 734 bp, Homo sapiens
gcgagacccgtctcgacaaaaataaataaataaatttagtcaggcatggtggtgtgcatctgtacgtcccagctgctcgggaggctgaggcagaaggatctcttgggcccacgaggttgaggttgaggttgaggaggttgatgccatggcatcatggaatcactgtactccactgtgagcaacagagtaagaccctgtctctgaataaactaaattaacagtcttgctttcaagggcaacctataaaaataatattatactctattttactaagtgacatcaagtaagacacattttttatagcttttatttatttatttattattattttcaaagtgggacactttatatctgggaaaagattatacttgttcgttttctaaattattttttaaaaataatatactctattaaatgacatcaagtaagacactttatatttgggaaaagattatactgattggttttgtaaattattttattttaaaaatatttctgtattttagaactgtgtcacttaaatatttaccaaaaaaaaatgataagtatctttcaaggccaaaacagatgaaagatttcatattaaaatgttataatctcaacacctgtagtatcatttgtgtacattatttttctatacagtctggatttgtgtcacttaatttctttgttcaattaataggcattagtttgaaagtccataaagttcaacacagcaaggtaattaacatctg

SEQ ID NO: 94394 - DNA, 316 bp, Homo sapiens
tgtatacgtttttcacttaacatataatgagcatttttccaagcatgttttggtagcatgagttttaatgactgtatagtgttccattctaggtatatagtatgctttatttaagtttgctttttttttttttgagacggagtctcgctctgtcgcccagactggagtgcagtggcataatctcggctcactgcaacctcagcctccctggttcaagcaattctcgtgcctcagcctcccgaatagctgggactacaggtgcacgccaccatgcccagctaatttttttgtatttttagtagagatggggtttcac

SEQ ID NO: 94395 - DNA, 610 bp, Homo sapiens
gtcaaggacaagccaagcctggagtctggtgggtgctcagcgaacgcagccatgattattactgtcatgctgctgaacctattggtctgtgagttggatcctggatactaggtcatatgtaagctggctagagtcaggtcaaagagtcaactaaagtgcccaagagtggtcaattttgcctcttagattgtttcacacgctgctgtgagactttctcaaaattctttcaagttgttaatttgttcacataaatcagtggttttccttctgcctgcactacagacccagaagtggatgttctttccctctgatggcactgtcaggtagaacagccaatgggtcacgaggtgagtggtcagaatggtcaggggagaggtctgctgtcacccagacaagcatcaccttgcttccctggagagaggcagcaaaatgaccaagacagagaaacaaaggggaggctatgaagggaggtagtgctctcctcttggagctctgtctttctggagaagatggtttgtggagttcttgtgcatgaaacttgtttccttctttctttcttttttttgtttgagatggagtctcgctctgtcacccaggctgaagtgccgta

SEQ ID NO: 94396 - DNA, 383 bp, Homo sapiens
ttctgcaggatgtacaggaagcatggcaccatcatctatctgctcctggtgagggcctcaaaaagcttccactcaaggcagaagagggaggaagcatgtcataaagggagataaggagcaagagagagtggggaggcaacgtcaactcagagtgagaactcactcattatgcggaggagggcaccaagctattcatgaggaatcagcctccatgactcaaacatctcccatcaggccccatctccaatattggggattacatttcaacatgtgatttggaggggacaaaacagccagaccacatcataacacaagtgtccactaatatggattaatagacacttgggtaatattatggactatagctcaattattttaatgag

SEQ ID NO: 94397 - DNA, 115 bp, Homo sapiens
catccctttccttgaatacttttcaccccatcaccgcctaattaagtccatcattcctttaaaacttccttcaggtgtcacttcagccagaaaccttttgctgacaacctttcta

SEQ ID NO: 94398 - DNA, 349 bp, Homo sapiens
ctttaagaaatgttatccattcccacagagtcccagtttgttgaccttcaggccacagagtaaaaccttccttttaagtgaagcattccccattgggaagcactccagctttttctttttatgaggaactttaactgctggacttaatttaattattgtattttgtacatactcccagaagccccagggcatgagctttacttttttcaaaactttcaaataaatatcttttaggatcgcacatttctgatggcagtgttccgtctttgacttgtatttctaatccaaatactgaacttggatctttctatttcctgtgacctatcaatggacgggtttcaaccatagc

SEQ ID NO: 94399 - DNA, 172 bp, Homo sapiens
gcaggacttggaagcagcataaataacagtgggtaaacacatgggctatgccatcaaagtgaatctaaaccccggctctgctgtggtttacacatccatttcctaacctataaatgggggtttataagagtacagtacctacttcaaggaattgtagattcaacgcaacatt

SEQ ID NO: 94400 - DNA, 174 bp, Homo sapiens
aaaaaaaaaaagaaaatgggaacacatctccttttgcagaaactgaagaaacgtttatattatagagccctataggtatataaaatactttacaatcattgtatatctagaattattttatctcaatttttacagattgagaatcaaaagtattaatcacgtacattgattgag

SEQ ID NO: 94401 - DNA, 490 bp, Homo sapiens
catcacgggcttcagggatgaagtctccacgtcctgcatctggacgtcttttccatttactcctcccagatcctctttctacccttgtgttctgctccctgccacaggagggaacctgtacaaatgacatcggggttcagccagtgcagagacatggcaggagggcaggaggaagaggagagtgaggtcaagttacccattgccctggctccttccctgtgttgtggtcagggactgctggctatgtctctccaccagagctttctgcaaggcagccttctctgtataaccctttccttggttttccttctaggtgcataggtggacagtgtttatagcccccagttagtgcactatctagccacatggtttctatattagtcatttgccataacaaaacaccacagaccaggtggcaaaccacagaaattcattttctcccagttccggaggctgaaggtccaagatcaaggtgccagaagggttggtt

SEQ ID NO: 94402 - DNA, 265 bp, Homo sapiens
gagtagctgggaccacaggtgtgtgccaccacacccagctaattttttgtattttttacagagatggggtttcactatgttgcccaggctggtcttgaactcccgagctcaatggatttgcctcccttgcccttccaaagtgctgagattataggcatgagccaccatgcctggcctggaatcttcatttttaacaagtgccccagtagagtgtttttgggttttgtttttgttttgagatagagtctcgctctgtcacccaggc

SEQ ID NO: 94403 - DNA, 775 bp, Homo sapiens
ctttgtaagtgctgctaggtcgtggttaatcacgttagtcctctagacacaggtaattctaatgtattactgggtatgggtgtacttgttagtagtcagctttaccaacaagtaatatgcctacaccatgtaaggcttttgttttggggacagagtgaaagcaatagttaacaattaccaagtaattaggagccgggccgctttatatgcatccttttatgattccttacaagtttatgacgcaggtggtatttttttccagttgtgtggcgtttttgcccattaggactcaactaaaaacccatggctttggccaggcacagtggctgacgcctgtaatcccagcactttgggaggccgaggcgggcggatcacctgaggtcaggagttcaagatcagcctgggcaacacggtgaaaccccgtctctactaaaaatacaaaattagctgggcgtggtggcacatgcctgtaatcctcgggaggctgaggcaggataatcgcttgaacctgggaggcggaggatgcggtgagccgagatcgtgccattgcactccagcctgggcaacaaatctccgtctcaccaaaacaaacaaacgaaaaccgtggcttttatccatgaagctattaatatattgccttcttttgaagtggaataaaacaatctgccttcagataacttaaaatctgatatgggaaataagacgcgctgtaataaataatatgaaagagaatgggataagtaccagaagattgtgaacaaaacctaattaataa

SEQ ID NO: 94404 - DNA, 1103 bp, Homo sapiens
ctgggacattttgctaaacatagaagatttcagttccagatttttcaggtgggtgggggagctattttagtcgggggggcaggggggtgggaaattttcaatttataaagatggacaatttttgtgttgtatttgaagcttttgaaagaattttgtaatattttccaagtttggatttatgtgcattgttaacaagaactgaaattctaacttttttggtaacattaaagtttaggtagcaggattgaaggaaatgatttaagaaggatatagctgttaaatgcaaatgaactgtcattacaaatgaacctttttggtacctgttgggagattttgggatttttagaagttaggccagtcacatctccagcttcttttgctgcagaaatatgcaactgaactcctcatggaggggtcatcaccacaaaggtcatggaagggtcattatttctcttgttggcattttattgcagcccattttaaatgtttgtacagaaatatttttcattctgtgaaaatttatttggagttctgtatgaaactggaagaactctggatacttttatatgttctcttttaattaaaaaaatgattagaattatcctaacactaaagtgttaaactggaatggttgacaagatattcaggatctcagtctacacattgaggggttggggaaaatgtaatgttgtccttagtttattttcctttctaaaaaaaataccccacgaaagggattctgatcagttctctgccatttccctctatctgtgaaataacagcttcgtataaccacaaccaaaaacagatgttctgtattaggagaatcgaattgaaagttattcaaagccaaaataagtttagatttcaaaatcattccagctctgcttttatctatcctggatttggtagaaaactaatttgaaagagaatttaattttcttaaaattccatatatatatatatatatatatatatatatatatatatatatatatatatataaaattgtctttaattgtattcaggatttattttaataataaccgatttggaccattttgaacattccctgttttaaaattcatatgacttccttttaa

SEQ ID NO: 94405 - DNA, 503 bp, Homo sapiens
aatgcttctcagactgtcctttctagactgcaggctcactgacaacagataggggtcctcctacatgagggtcctcccacaaatgctccgcaatacgggtgacaggccagtggggtgttccccagctcctaccaagggctcacagtctcgggcaatctctatcctcccatctttcagcctctgctgcattctgacctcttcattaaccccatcgggaagttgtccccccaagggcaggggaagccatccaggggctttcattatccgggtctcaaatctggggccagattcagccaatgggtagggtacaagaaggccttctacgtcccatcctggagggcagaggtctgggccgtggctggaagaaagcctgctctggtgacccctctcaggccctggcccaccccagtcctgcccttgacgacaaaagagggtgtccctgtctctcaggggtctaggatcctggacactgtgtctgctttgaagggaaagacgcctctgag

SEQ ID NO: 94406 - DNA, 220 bp, Homo sapiens
gaaataaaatgttaccctgagcaaaaacaatgtcttggcagtgataggctacaatgatacaaaggtcatggtcttgtttgaaaaagaaaacaagcgtaactataatctggcattttagatccatgcactcatctgtgaattctttactgctctttgtaggaaaaaacacacaagcttcctgtaatatactcaagccagattggcacctaaacttaaactg

SEQ ID NO: 94407 - DNA, 644 bp, Homo sapiens
agggtctgtgaggtgcggcgcagggtctgaggtgtggcgcggcgtctgtgaggtgcggcgcggcgtctgtgaggggcgcggcgtctgtgatgggcgcagggtctgtgaggtgcaaaggccatttagtgtgtggccttagttaattttttgttttcaattttctgtctctcatgttattgatctgtaaaaggagcataatcgtaagtgtctcttcttattaggttacttgtgaggcgtaagtgaagtactatgtgttaactagtatcatgaaactacagcctcactctccggaggaaatagtgtaatgatagcgccgtttacagggtgcaccgtaacaggaggcaaaaacagaggtggatacgtgcagagaagtctttaggtggtcttgacactagagctgaatttgaaggaagttgagaacttgttagatgaagggacctgagaacaggaacaagtgttcaccaagaccggtctgtgtgaacacacagaggcggaaatcatgccaaaacttgcagagtggcaggaaactccattcagctggagaaagcatacatatggagggagtgaaaggagataacagtggagaggtctgggcaaatttaggctgacttcaagaaggcaggagtttcctgtgaagaaaattg

SEQ ID NO: 94408 - DNA, 739 bp, Homo sapiens
ggaaacttgtaatcataagtacattttcttcaaaaagatgaataaggaaatgggaaataacatatttcctatgttttccctaaggtagacctgtcgtaacacagattcagaaagaaaaatcagtaagaaggggtttctccatgtaatccacagttttccccctgctttgaaacagaaatcatcgttcactacagaagtatctgtaagcaaaacacactttatcctctctagggaggagaaagggttaactagctacagtcaccagcaggaccaccacagagcaggactggctgggcccaaacctgctcccccatcccttcaactcctctaactcacagctccttgttttttttctttcttaccttcctcgtaattctctcatgtaaacctcatgcccagtgatgtttgcccaatttctgggaaaagataaagctccagaaacaatttgattttcctctaacatttcaaaatatttcaagtcaaaacctgaaccttggaaaaaaaaaaggaaatctttgaaaacagcttcaatcactgtccaggttcacaaatatctagttaccagactcatagttttcctactttaaacaatgaagaactatcagacaaaagaagaaatgttgaaaaatttagatgacaatgaatttcattgctgcttgctctcagggagtgttattgctaacttagtaaacaaaaagggagcttgtcacagatgaatgaacatttcaaaactggctgc

SEQ ID NO: 94409 - DNA, 457 bp, Homo sapiens
cctgtttctgcctgcagcttggtcctaaatgtgagacaattgtgaaaagtggaggacagagccacctggttaaatacagccccagctttctggtgagaggactgaaaccaagatgtgtcaagtaactagaatgtgcctggacagatactgtagaaagcaaaaccataaagttgttcatgagcttgtggacgcacctgccagctgtgaataagtggctctaatcccgaacaacttacctaaaaagagcctgagagctgaactgtgcaatggcccactttccagtcctcactgaccactgggttgcacacactttggagatctctgaacagcagtgtcaaggctttcaaatagagttatctttgaaacgacaacacatgaaagtctggttggtacttggagcttgaatacaaggcaattgtgtgcctgcaaaaacaaaaatagcaatattatccttaag

SEQ ID NO: 94410 - DNA, 397 bp, Homo sapiens
actgctgaccggctcagtgaggccttgctgagccagcattaaagactgcaacactttcttttcctttctcagttctttcttcttagtgcttcttagtgcttgccaatatccaacttagtatttctctctccccaccaaaagaataaaagttccctgcgtgcagagatacctggtcggcagatggatgaaatgatataaatttgctaacaagagatccattcagacgcttccatctgaagcctccatttgctctatcaccaaacgagtaggaataactgccagacataccccagatctacatgggaacatttaaagcaggccatgccctcttcaaggccccacacaaacattgtggcaggaggcagggctggaggggagcatcagagcagacatgggg

SEQ ID NO: 94411 - DNA, 803 bp, Homo sapiens
tccagcatgaactccatgtcctccaggaagccctggtggacttgggcagacctggggacacgtccagcctcctggcaagatgggggtaacaggagtgtgtataaaggggaaggcaagaatgtgcccttggtggagcagtgaaaagaagccctcatgtgacaagtgttttgctcctaacccacctcctctggtgacatcttctgggttaactgctcttgctgatctctgcacataaaccaagctaactgtgagaggcctttcatttctagtttaaagcaaggagaccacagttccttctgaacactcacccccaaggagataaggagggcgtcccatgagcaacactgtgtgttaaagatgtacacgagcactgggacctgaccaaggacaaacacgtctccagccccctcagacccttgctgctgctcagatgtccgctgtcatcggtcacatcctaacctcaaccccctctctcctcccacataaaaggaggctgaaattcatagtaacttcagatggttctttaggacactggcccaccaccttctcggttgctggctctccaaaacaaagccccctcccttgacccaattccttgtttcttgacgtactggctgttgtgcagtgcatggtaccggcttgaactcggttatgttggcatggcctctggcggtgctcagtttgtgtggatgagtattttacagctactgtcctatttccagtccccttcctctggacggctatgggatgtgctgtggatgccctctcttaggctggaataaaccaccctaccttctcctctg

SEQ ID NO: 94412 - DNA, 331 bp, Homo sapiens
ctagcaacagattttaagcaccaatttgcctttgggcttcaacaaactctacccatatttccattcttgatttgttttaaaaagacattaacttttatttttaacttcttgttttagatttagcattctcaatcaaggtatgaataatgcattatggttagccttctccttcaagttgtattctatatgattcccaattcatcagacaatttgagtaagaaaaacaccttctaatttgtttgttgctatgtaaacaaaacatattttttcctagataatactttgcagattgaatatgaataacaaaaatctatttaaagtatattttata

SEQ ID NO: 94413 - DNA, 181 bp, Homo sapiens
gatttctaatttaattgcattttaatgagaaaaagtagttctcatattactgattctttgaaatttattggtaaaggctgggtgggcatggtaactcatgcctgtaatcctggcactttgggaggctgaggcaggtggatagcttgagtcaaagagttcgagaccagcctgggcaacatga

SEQ ID NO: 94414 - DNA, 318 bp, Homo sapiens
cctgtattcaactgaaacatttaaggaggtcagcattaatattatgtcaaaagcacaaagcttgggttagacaaattagatgagtcaacattttggctctgcagctggttaactgtattcttaatcaggtacttcactaaacctcagtatactcactcgtcaagctgggttacgattctgtagcaaccaccttagggtttttgtaaggctgtaaaaagtgaaaaagaatgcatgtggagtgcttagcccagtgcctgcgaccttgtatgtgttgacagctgtgatgattctaagtggcatttaaaattatttatttat

SEQ ID NO: 94415 - DNA, 335 bp, Homo sapiens
tgttgctgcagagcctttcctgaggttggggagggtgtctgcagaaggaggctggagactgctgtagaatcactactactggtgacatcgttgttcttctctgacctgacccctgagttggtcagacttggccatgtggacaaccccctgcttctcccactctctgctgccctaacctgagactggttattcaagtgtcttcctcactgtctcccccaaacaggaagtattttttgatgctcttgcatctggggctgacccaacactgctcatcccatgtggtcattgctggcttacaggtcagtctggcccttgcattcgatgttctgtaagga

SEQ ID NO: 94416 - DNA, 806 bp, Homo sapiens
aggtcatacactgattttcatgagctacgcttctgttcagccatatgctgattttgctgtctacctgtgcactccttccttctatgtatgcattctcaggtttccctgaagaagatggatgttttcccttatttcctcctctactttgtagattcaatcttgccattatctcaggtttccaaaatctcaccttttctttttgactgcacattattttaaaaaattttgttcatgcttattacaaactcagaacttaaaagggaataattattgtctgttttcaaatgtggttgcggatttctaaaaggttggctagcagttattatgcctttacctctcaatgagcacagcccagttctcttatattaggttagaggaagaatggagaaggaaccagacctactaaagctataaggtgaggagagaagttaaaccagacagaatgccagaaagtttggaatatgacataaacctaagagtagttctcagaccagtgggtgctgtcggtttcggtttatgtgactaatcctaccattaccattgtgagatttcttcctaaagtaaggcaactaatcctagaatttcacaattaaaaccaactgttaaatactttaatttaattttatatactattgctcaattttgcttcttgagttttactggtttattttagttttatggctgataaacttatgtgaatattgtttgtctgtacttctccactgaaaaaaatgcttaaagttattgtactctaaaaccactagatactgtaccatttatttatcttatagtagaatcacatatta

SEQ ID NO: 94417 - DNA, 342 bp, Homo sapiens
tctaaaccagatgccccattttacagaggaatgaggcattcgcaggctaaatgactcgtgcgggtcccccaatagctgatggcgaagctgtgaattcagacccccacttcgcttgagcagtgacgggaagctggtgacttcaggctctggcagaggctggccctggtgacctgcccacctcctcttctgtctcctggaggctggcccttgtgacctgcccacctcctcttctgtctcctggaggctggccctggtgacctgcccacctcctcttctgtctcctggaggctggccctagttgcaggaaaacaggcttagggctgccactgattctacattatg

SEQ ID NO: 94418 - DNA, 420 bp, Homo sapiens
tgttatgatttccacctcttggaagaagaagtgcaagtgtcataacaagtttacgttagatattatttggggattatcaaatcaggccagagggaagacttattttgttttgtgttttaacattagcaaaaacactctgtcttaccaagtcaggttatctggtggtgctgtggtgagcagccatcatctctgcactgcctctgactggcttgcaggagaagagaattgcgtgtgaggtgacttgctgctttggagatgttcccagccaggacagctccacaaggagcaggcatgggatgtgtgtggacctgcaccaggaagagggcagcgggcctgtgatgactggctgttagaatgagtgccattagaattgcctttttttcaagttttcatgagactcaatcttgtttttctgccttt

SEQ ID NO: 94419 - DNA, 6839 bp, Homo sapiens
  misc_feature (3)..(3): n is a, c, g, or t
gcncaggtactcaggtatgtctcaagtccatgtcctccaaacagactcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagaagaggcagccagaattctcgcccaccagccaatgtccgtcggcacatgtgcagctttgaaaacccccacactgcagtgaatgtttctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaaacccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgccccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccgggggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctccccagtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttcaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttggcaaggaacagaccacgtggcatccagtcggatcatgagttcacctgatgcattcggagtgagctggtggagccagacagagcaggtgcggggaagggaagggccaggccagacccatcccaaacggatgatgggatgatgggacagcagttccttgctcagaagcccttctccccgctgggctgacagactcctcatcttcaggagactcaggaatggagcggtacaggggtctctcttcatccaccgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgacctgtcaatgtcaacctagtagtcaatctaactgcaattagaaattgtcttttgaatatactatatatattttttatgttccaataatgttttatacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattgtggcctcttttaatttttatgttcatggacttttattcctgtgtcttggctgtcataactttttatttctgctatttgctgttgtgtaatatccatggacatgtaatccacttactccatctttacaatccctttttaccaccaataaaaggattttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaacgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctatttatt

SEQ ID NO: 94420 - DNA, 6754 bp, Homo sapiens
  misc_feature (3)..(3): n is a, c, g, or t
gcncaggtactcaggtatgtctcaagtccatgtcctccaaacagactcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaaacccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgccccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccgggggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctccccagtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttcaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttggcaaggaacagaccacgtggcatccagtcggatcatgagttcacctgatgcattcggagtgagctggtggagccagacagagcaggtgcggggaagggaagggccaggccagacccatcccaaacggatgatgggatgatgggacagcagttccttgctcagaagcccttctccccgctgggctgacagactcctcatcttcaggagactcaggaatggagcggtacaggggtctctcttcatccaccgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgacctgtcaatgtcaacctagtagtcaatctaactgcaattagaaattgtcttttgaatatactatatatattttttatgttccaataatgttttatacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattgtggcctcttttaatttttatgttcatggacttttattcctgtgtcttggctgtcataactttttatttctgctatttgctgttgtgtaatatccatggacatgtaatccacttactccatctttacaatccctttttaccaccaataaaaggattttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaacgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctatttatt

SEQ ID NO: 94421 - DNA, 857 bp, Homo sapiens
agcggtcttgaactcctgggctcaagcaatctcctcaccttggcctctaaaattgttggcactgcaggcatgagccattgtacctggcctaatttagatgttaaaggattgtaacagtgttagtaaattttatgacaatttgagaaagagaaactcctaagtcattttggactaatattaatcctgtcactttgaagactatgctaaattttgaatgtgaatgaatctcattttaagaactaataccctaaaattgcttaatgactcaagtgtgctattatataatagaacttaaaagtagaaaacatctaatactgcattttttcctagtgaagggataagcagttgagacattttagctctattttgttttgtcatttttgttttatgatcacaggattacttaaaaaggtggacagctgggcacggtggctcacgcctataatcccagcattttgggaggacaaggagggaggatcacttgaacccagaagtttgagaccagcctggacaatgtagtgagaccccgtctctacaaaaattttaaaaaaattagccagttgtgttggcgtgagcctgtagtctcaactactcaggaggctgaggtgggatgatcactcgagcctgggagattgaggctgcagtgagctgtgatcttgccaccgtactccagcctgggttgacagagtgaaaagacaaaagaaataacaaaggggacctaacttttttacaagcacgaattttgtgtagtgtatatagaaagtcaattttttaatgtgttcagcagctgaaatcgtgtatacttccccatgtgcaatggaacagaaaaacgctcgttgttttagaacaccagaata

SEQ ID NO: 94422 - DNA, 544 bp, Homo sapiens
cagccatgacacggaatatgtattcattgcctttcaagagtttagtgacctttagctttgttacttggacttctgaggctacatttgtccatgccaatctgctggtttcacgtttctgtactatgtaatgatcaattttggcacctccatcatccagtggagggaaccatgatagtacacacttttctgatgtcacttcagttacagccaaaggtccttcaggtgggcctggtctgtcaactgaatttgacatctgaaaagtgtgtttagcaaagccaccaggattagtcgctgtaagggtataggcaccactatcccttcttgttgaatctttgtttaccagattagtagagaaatctgcaatttttatttctaactttgctgtgccttccagctcttttccatctttgctccattccattgttggaggtgggcggcctgaaacatcagcttccagtctgaatgcttcacctgcttttaatataaccgtgtccttaaatttaacatccacctttatctttggtgccatcaagtccaccatctg

SEQ ID NO: 94423 - DNA, 210 bp, Homo sapiens
ggctaaaatgtttcggcccccactgataaagaacacgctaaagtcaatttcaacactctagacacagtaacaatcttctttttttctctttgccaaaaagagtgcaatacccagattatagtattcatctgcatctctctgtaaagttactttatgagagtgggctctctcaaaggcaccacgtagttgggcctcgactctaatgacacg

SEQ ID NO: 94424 - DNA, 344 bp, Homo sapiens
agagaagcatttaacacattatggggtatctatcggacagaagggcacatgatctgtaaacaaatgaggagacctagatttactgatgtggaaagatgatcaacatgtatcgtatttttttaatttgcaaaagattaaaattttacttctattttaaaaataatggtaacaggcagggcatggtggctcaagcctgtaatactggcactttgggaggccgagaagggagggtcccctgaggtcaggagttcaagaccggcctggccaacaaggtgaaaccccatctctactaaaaatacaaaaattagctgggcgtggtgaggcaggcgcctgtaatcccagct

SEQ ID NO: 94425 - DNA, 253 bp, Homo sapiens
gctcaggaagttcttgaagagcgcttcatttatgatagaacacactctgttgcctctcagaaaagagctttcattaagcacaaacagagctgctctagtaaatgggctctcaacaaacaggagtactgtaccaagcaataagacagtgattctttgtgttccgagtttgacacgtggtgtaggacttctctgcctgggcactatggctcacgcctgtaatcccagcactttgggaggccgaggtgggcagatc

SEQ ID NO: 94426 - DNA, 206 bp, Homo sapiens
ctttaattcaagagcaatgagttattaaatgacatttcataaattgtgttgagtcttattattccatacttttatagaatattaaaatttgaatgtgcatttacactttggaacaccagttatggccatttaaaaaatatttgcatcttctaattggattgcaaattttcatgaatttttatggttattattgatgaggagctaaa

SEQ ID NO: 94427 - DNA, 542 bp, Homo sapiens
ttttttttttacttttaaaaataaagaggtagaaagtggggaaccttgcttttctgggcattgggtcaagaccacacagagcgtgggagcaatggcagctggctggggctggctaaggccgcactccctttgctctgcctttggccataaccactagaccgcacgtttgcactattttccaaataaccaaaagggaagacttttaaaaccatactagaacataactttgtttttaggatgtgtttacttgttctggtaaaggtcatggggcaggattttggggaacacaactaaaaagaatgcagtaaaactggcatcataagctctctcaatttgaccacatttgagcccagttcagcaaatccaaagatacattttcaaaaatgcatatcctgtttcacacctcaccacaaagcaaacaacctaatttgcagactttctaatactcataatgcctctaggtcctcctgtcaacatgtgtttttaaatatcatctttgatttgatcactaacaaatattaccactttctggtttttggaga

SEQ ID NO: 94428 - DNA, 338 bp, Homo sapiens
ttttttttgcaattttaggcactctaatacttatgaactgttaccacattgtagtgttaacttaaatttctccaatgaattatgatgctgagtatcttttaattgtgcttatattttatacacctgctttggtgaagtgtccatggaaatattttaccctttttccaaaaaaccaaaaaaaaaaataaaaaacaaaataggttttgttttcttattgttggttttcaataattttaaactatattctgtatgcaaatcttttgtcagacatatgatttgtaaatattttctcccagtctatgattctgcttttcattcttttaacagtacctttcaaa

SEQ ID NO: 94429 - DNA, 409 bp, Homo sapiens
cattatggatggctttgagagtctgtcacaacagtttagccttgaggctgcaatcagtagtgattcaattgagccttcttgagttgtgcagagagattgatttgatgaaaacgattttagaaaaatgggtctgatggtgagtgaaaatgaatcaaatggaggagaaaataaatacagcgagaaaacaatcacaggaatgaagtgaggaaaaggaggaggaaaggtgaatccaagtgacattttggaggacattggacattattaagaaaactacaagaggcgtagtggtaaagggaatactgaggtttcaggccaaggtgataaagaaataatagggatatttgatataaatttaatagctgatagaaattgagcacttagaaagggaagtggtttgtggagcatgagg

SEQ ID NO: 94430 - DNA, 814 bp, Homo sapiens
ggaactcttgaccttatgtgatccatgtggccactttggcctcccaaagtgctatattacaggcataagccactatacctggcccttctttcttttggctaactctctgagcaaaactctttctgccatgggagatcattaccttatcattggtcattttcaggatcttctgagaacacagaccagaagtactgaggtaatcttggcacattttcttaactattttatgctgcttttaaaataccttatatatagctgggaaaaaaggttttgctagatgatctttcaaccttcatgaaaataaagattttactaaaaagtttaaaccaaaggcactgatggaaaatacagaagaaaacctaaacaaagtttcagttctcagcccctcagcagccactaagtgatgggcatttccttcactccccagtgagcacctattgtttgccccgcatggtacagggaagccagaatgggcatgggaggagcagaccaagaaacacgccttgggtgggggccacagagggcttgggtgaactcccaggacagggcgggaagggaaggcagaaaggctatgagcatgggctgcactgtcagctttggaagggtgcagtgaccctgcatctgtgggaagtatggggcacaggcagcctgagctgcagcctcagagtggactcatctcggggtccacctggccatggcctggattaagtttaaaatgatgagcccgtctccaacttccatacatgactttgcacaagtctgacaaacacttttgggcctcaggaacagcaccttaagtcagagtgcctgcttt

SEQ ID NO: 94431 - DNA, 593 bp, Homo sapiens
aggaatgaatggtatgtaaatacagtaggaatgtaattatagattttcctgacccagttcctaaataatagatatcatttcagaagtgccccaatacctgaccttttgctccaagccatatcaaagcacacatctagtctacttttcactctcattcctagccactatgacaatactattcagataaaacttctagtcctctacttatgtgactcataccaacttgaccttacgatagtgactgggggtgcatatctaggttcatgctgtttgtccattattatggttttgtgagaaaaggcaaaatttctaggtaaagtgttatgaggacgaataatccaccaggcaaccaactgaccctttcatttgccatcttgtcacttcaaacagctctccagaacctgcagccagcacagaccaaagtcaggtttgtctcctcttctgttgatgaacaaaggttgattccatatcgtggctattgtgaatagtggcagtaaacatggcagtattgtatgaaaatatcacagatagcccttaaatatgtgcaactatgatgatctatcaaaattaaaaattaaaatttatttttaaaa

SEQ ID NO: 94432 - DNA, 874 bp, Homo sapiens
acagtggcgcaatcttgactcactgcaacctctgcctttcaggttcaagcaattcttttgcctcagcctcctgagtagctgggactacaggcatgtgccaccacgcctggctaatttttatattttagtagagatggggtttcaccatgttggccaggctagtctcgaactcctgacctcaagtgatactcctgccttggccttccaaagtgctaggatgacaggcgtgagctgctgcacctggccctatttatttatttttgatgtagagtctcgctctgccacccaggctagagtgcagtggtgcaatcttgatcttggctcacagcagtctccacctcctgggctccagcaatcctcccacctcagcctcccaagtagctgggtctacagttgcgcaccaccacacttggctaatttttgtatttttgcagagaccggttctcaccagattgcccaggttggtcttgaactcctgggctcaagagatctgcctgcatcagtctcccagaatgctgggattacaggcgtgagccaccgtgccagccctcttgggggtttctcgggctaagccattacctctcagcctccgtgccccggtgggctctgaaggagcctgtttcatcctgagcaatggtggaggcggaggctgcagaggaggggtgaagtcctggggctctgggggagacaaaggaccctgctggtgtccctcagacccgggttctggcccctctgcttcgtgtgacttcagacaagtcgctttacctctgtgagtctgtttccccagctgtaaaatggggatcataacaccaacctacctctcaggatccccaagaggaggaagtaggcgaatgtacaagaaggccccttccac

SEQ ID NO: 94433 - DNA, 1581 bp, Homo sapiens
taaagatcaggctcagctgctgctgctgctgctgctgcttgtcccaagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaaggtggacctgtggcagcccagcagtatctcctatgtatcagagggaacagttactgatgtccatatcccccaaaatggttcccgagccctgttagccttcttacaggaagccaacatccagtacaaggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatgtctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgctgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtggtaagtttgggaccaactgggatccagatccaaaggtttctgcaggttttactctgcaaaatatgagtccagaggactctcatgggagactcatgtttttctgtatgtgaaaacctggtagagaaaggtacagatacgtacatgatagctgtaattggcaaaagaaaatgaaaggattcttttttaatatataaaaatcaaggattttaaatatgtcaattcggtcctgaaaactgaaaatttaaatacatatgtaaaagcagcaaactgaggaatatttgtcattccccaaattaaaacatgaaccgtggtgtagtataattctggttaaatctttttatccttttcatacaagcaccactgatgctgcattcggctgtctgtcgtggtcagagctgtcatgaccttgtctatattctaccactctgctggtcatacgtggattgaccatgcacattggaatgtatttctgctgcattccatgt

SEQ ID NO: 94434 - DNA, 1898 bp, Homo sapiens
ggctgtcgtaaaaggacgtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggtatcagacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaaaaaatt

SEQ ID NO: 94435 - DNA, 431 bp, Homo sapiens
ggctgtcgtaaaaggacgtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggtatcagctttttttgatatcagttggtagttggaaaaactatatactattttatctgacgtatacctgaataaaattttagtgaagaca

SEQ ID NO: 94436 - DNA, 684 bp, Homo sapiens
ggctgtcgtaaaaggacgtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggtatcagctttttttgatatcagttggtagttggaaaaactatatactattttatctgacgtatacctgaataaaattttagtgaagacaaaaaaaaaaaaaaaaaaaaaaaacaacctgtttgggcacgctaggcccccgaaaaaagttttatacacacatcggtgggggcggggggcccaatgggaacggacatgtgcaaagggtgtccaaagagaaccgggcaggacaagcgggggttcccacgatataaaaggccgggggacacggggtttgaaaacccaagggatcggagcctcgggcttccacaggtccaggagcggataatcgcccgtggggagat

SEQ ID NO: 94437 - DNA, 332 bp, Homo sapiens
ccacaaagaaatgtaattattattaaaacataagttgtcataagagaaaaaaagaagctggcagaagtttcgtatttctcagtaattctagaaaagctatgcaaatatatagataagaaggtattttaaaaatcagaaatggtagtatttaaaaattcaatgtagttacaggaattattatagacaagaaagcttaagctgttggttccttcaaactttatttgaattaaattcattttgaggaaaatacttccatctctttggcttaattaaataatattaggataagtgtacagtttacctttttttcttttgatatgtaactgagtttt

SEQ ID NO: 94438 - DNA, 1471 bp, Homo sapiens
  misc_feature (46)..(46): n is a, c, g, or t
  misc_feature (56)..(56): n is a, c, g, or t
  misc_feature (83)..(83): n is a, c, g, or t
  misc_feature (97)..(97): n is a, c, g, or t
  misc_feature (150)..(150): n is a, c, g, or t
gtaataattttacttcttgatgatggtaatttttcatgattaaccnattttgggcncctattccgccatatatggttttattnaattttcacagcancactttcaaagttgatattcatattctaaatttatagatggtaagagggtagnaggctcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaaaaaatt

SEQ ID NO: 94439 - DNA, 1637 bp, Homo sapiens
gcattatctgtgttttctttgtctggaatacttttccatcttggcttaccctattgccctcccattcttcatatggctattaagacttcgtgtctctaagatgcctttcccaaatcccatgtctgctttagtgcccttccctctgcacttcccgttcagtgcttagtgtcttgtaattgccttttcactgtctccatccctagttagaccatacactgtgtgagagtaaataggctgttcaccattatttcatttcatcagggcccttatgagtactgaaatatttgtgaacagctaaatgtacttacatgtcatactcaatatagtctgccttttgttagatcattgttcagaagggtcctgacaaaaaccatttctgttaagaaaatgaaatgagaagtgtgactgctcccaacaaaattgttaatctcactgccttaataaagctatatctttaaaacactgaatactgtctttttgtatatttttacatttttatttatttactttattttgcttctcctatacaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaaaaaatt

SEQ ID NO: 94440 - DNA, 1160 bp, Homo sapiens
atgctgtccagagttcccaagctttggtcagcactcatgtctcctgtctaagggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaaaaaatt

SEQ ID NO: 94441 - DNA, 376 bp, Homo sapiens
gacgtgatgcgtgagagctgttctagagtatcccagaactgtgagactcctcgaaggctctagctgttagtaccttctttcccggagtcctggtccacgagttggatttactgctgtcgcgggtgggcctcacgccattccctgtccctcggccccctgagggaaaatgcctaaaaaaaagactggtgcgaggaagaaggctgagaaccgccgagaacgtgaaaaacaactaagagcatcaagaagcactatagatttagctaaacatccatgtaatgcctcaatggtatcagctttttttgatatcagttggtagttggaaaaactatatactattttatctgacgtatacctgaataaaattttagtgaagaca

SEQ ID NO: 94442 - DNA, 399 bp, Homo sapiens
gacgtgatgcgtgagagctgttctagagtatcccagaactgtgagactcctcgaaggctctagctgttagtaccttctttcccggagtcctggtccacgagttggatttactgctgtcgcgggtgggcctcacgccattccctgtccctcggccccctgagtgagtccggtctcccggcgaaagggaaaatgcctaaaaaaaagactggtgcgaggaagaaggctgagaaccgccgagaacgtgaaaaacaactaagagcatcaagaagcactatagatttagctaaacatccatgtaatgcctcaatggtatcagctttttttgatatcagttggtagttggaaaaactatatactattttatctgacgtatacctgaataaaattttagtgaagaca

SEQ ID NO: 94443 - DNA, 776 bp, Homo sapiens
  misc_feature (677)..(678): n is a, c, g, or t
  misc_feature (755)..(755): n is a, c, g, or t
  misc_feature (766)..(766): n is a, c, g, or t
gaaaaaaagaagctggcagaagtttcgtatttctcagtaattctagaaaagctatgcaaatatatagataagaaggtattttaaaaatcagaaatggtagtatttaaaaattcaatgtagttacaggaattattatagacaagaaagcttaagctgttggttccttcaaactttatttgaattaaattcattttgaggaaaatacttccatctctttggcttaattaaataatattaggataagtgtacagtttacctttttttcttttgatatgtaactgagttttgtatattgtggatagctgttaagaagttgtttttcagagaaccctttttatttttggcttagagtgagtagtaaaatgtttaaatgaagcggcctactatcattgagggttgataaattgctaaatgtatacagttttgatggttgccgtggttaaagaatggttgcaggtggtcaggtgataatgattatgtattcttgttccttggttacagggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggtgagctcatcacacacaagtaatgagctttgttatataggtgaatgtnntgactttcgcccaccctcctcaatgctgtttttgagcatttttttacagagatactgtccaattccctaactactgntgtactgtttnctgattatca

SEQ ID NO: 94444 - DNA, 1897 bp, Homo sapiens
gacgtgatgcgtgagagctgttctagagtatcccagaactgtgagactcctcgaaggctctagctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggtatcagacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaaaaaatt

SEQ ID NO: 94445 - DNA, 707 bp, Homo sapiens
ggctgtcgtaaaaggacgtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggtatcagacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatgaaacacatttaaatgtttctgcctctataacctggcagctggcttgatgctcaaatgtgatactcacg

SEQ ID NO: 94446 - DNA, 389 bp, Homo sapiens
aggactccaacagttgttaatggagtattttagaagtcctttggccaaaaacacctcagtttacaagcacagaatgccctagcctctcattacttctgagctgtctctacttcttactctataaccctgtgtgaacgacatggatgttctgaccatgcgtacacttattttccctccccacacatgacgtctatggaaaatcaacaacacaacagtatgagaaaatgtttcatggcatacctggtagaacacaaaaccaaaagttttggccttcattttgacacttaaataactcccacatgcgtagtgttctgataatggaaaactcatttatgcctagtgttccattattggaacgctaagcatgtgagagttatttatatcctaca

SEQ ID NO: 94447 - DNA, 895 bp, Homo sapiens
acgaaatcttgcactgtcacccaggctagagtgcagtgccgtgatctcggctgcaacctccgcctcccgggttcaagcaattcttgtctcagcctcccaagtagctgggattacaggcacccaccaccacacccggctaatttttgtatttttcagtaaagactgtttcgctgtgttggccaggctggtcttgaacttctgacctcaggtgattggcctgtctccacttcccaaagtgctgattacaggcctgagccactgcacccaacattattttcaaaatgacaagaggtagtatttagtacctgaggctcagatgttaaacacaaactcagtatttacaaaaataaacatttaaaacatttacacttcaacttccaaaatggctttttaccataaacattcaggattttcaaacctgtaacagcttatcaatgcatctcatcttagaagtatgttttacattcttcataaaaataaaaatgaacccaggcttcctaagattcaggccagtgggtctccacttaaggccaaatggagaaataattttttgctgcctaaacacacaagtgaattgaaaagccacaggccattcattcaacaaataactttattatttttattgataatgtacttgtaatgtgctattttgatacatgtatgcaaagtataatggtcaaatcagggtatttgaatatacatatatttcaaaatatagttatatatttcaaaataagatatagcaagttagaagtatatataagtatattattatatgttattgttaactataatttacctactgtactatcaaatactagaacttattccttgtatctaaatgtattcttgtaaccattaactaacttttctgaatttcctactctccccttcc

SEQ ID NO: 94448 - DNA, 305 bp, Homo sapiens
aaaggaaatacctctttaattgctctaccaattctaaatatttacctgaaaaaatatggtaatttttactcccaaatgaacatccctctcctgtaaagtctgcaacaaaatcactttaggctgcttccactttgggttattatgaagagtgctgctatgaacattcgagtataagtttttatgtggacatatgttttcatttctcatcagtacatatttaggagtgaaattgttgtgttatataataactccatgtttacctttctgagtaatagccaaggtgttttccaaagcagctgcacaat

SEQ ID NO: 94449 - DNA, 373 bp, Homo sapiens
ctttgctacagcagacattcttcaacttaaattgtaagctctgcaagatgacttttttaagggacaaaaagactatgtttccattattctataggttaacagaaatcaaccaagtttattttataataatacttaatatgcatactaatggtatgtgtgtatatgtatacactgttgtctatgtatatatttgcttgtagtataagaagactaactgggcatagtggagtgtgcctgtagtcccagctacttggaaggctaaggtggaaggatccctcaaggccaggagtttgaggctgcagtgagccatgattagtcctttgaatagccactgcactccagcctgggcaacaatatgagattctgtctcaag

SEQ ID NO: 94450 - DNA, 358 bp, Homo sapiens
ccccttggtgaagggtgatttgctttattagatattaaaatttatcacaaaaacaatgaaatagcatgagaaaagactagaaacaaatacagaaatagatacaaaaatatataaacatgttatatgacaaaatagagatttatgtttcagtagtggaatcacttaataaatagtactaatgtaattagccagccataaggaagaaaagtataaaagaatgttaattcatgctattcaaaaatatattccaagtagaatgaatattgatatgtcaaaagtaaaaattaactcactgtaagattaaataagaaaacacttgtatgatcttggagtaggaaaaatcttcctaattattaat

SEQ ID NO: 94451 - DNA, 310 bp, Homo sapiens
aatttgcagttgttaaatcaaacctactgacatttatagtcccttactttctcttctttcttccattgtaaatgtctgaaatgtcgtacagtcatacttcccactgtatttttaggttttactctcatacttcaataatcactaccaccctttatttcaataaaagttttaagtcagtgctgattttttggtagctcccattttctgatatatttgtcatgtacatatgcaagtgtatgtaatgtaggtgtgcatctatatatacccacatatacatatatacatatacatatatatgtccatatacacg

SEQ ID NO: 94452 - DNA, 193 bp, Homo sapiens
caaatgtagtttgtcctcatgacccccttacacacagttccacttcctgccttgggtgaagccaccccctctttatctgaaatggccttatccaactcctatccagccttctctgttcccacatcaagactgtctgtctgccaggcacggtggctcacgcctgtaatcccagcactttaggaggccgaggtgg

SEQ ID NO: 94453 - DNA, 723 bp, Homo sapiens
ggtggaggttgcagtgagttgagatcacaccactgcaccccagcctgggttgacagagtgagactctgtcccaaaaaaaaaagagggagatgtctggaaggctaggagatttgagagtaagagcatgaattcagctctgttacctgtagcttccagaaaaaggagctgtatggggagagagaatatggtcccatggagaattttctacaaatgtgcaagtgcaaacgcctgtgtggcttatgagaaggcactgcaggccttacgctgtttccaacattcccgacattttcacacctgggttggtgtctatgtggggtctgtgtgttgagaacacctgaacacctgctcctcttaaaatgagcccggaggttgtgccaggcacagctggagcagtgcagcgcctagatgtggctgtggaaggtgagattaccgcctccagggctcccaggctggctcctaccctgtgggctcctagcaccctatccccaccctccctgcaggaagcatggctgagtgctgggcacctcccaccctgggtcactcccagtgagtctgggaccaggagactctggtgaggctgtggggattggccttccctggggagctgcctggggctgccctccctcctgacggcccccagccccttctccgcatgttcaaaacaggaattctgaactcatagtctccagccacacgtatgttaagcgaaactcctctgtgccc

SEQ ID NO: 94454 - DNA, 514 bp, Homo sapiens
atctcaaaaaaagaaaaaaaaaagttaaatcaaaccactatccaaaagaattagaaaaagttctgtggggaacatggacttggaaataaacattttgtccagtggtaggagaagcttgggttgtgagggactggttaagtgctttactcagttttctgtgttcactcagtggcagagcgagggctgattggaactggtgcccacccttctacaggccagttttcattttcatggcagcatactctctagttggagttgagcactttttcctaaccaacctttaaacttattttctcccattacaagagtgatgaaagtagcataataactattagttttctactgttggctgtaacaaattgccaccaacttggtggcttaaaaagtacaaatttattatcttacagttctcttggttacaagtctgacacaagtctcactgcactgaaacatcaaggtgtcagaagggctacatctcctttcaggaggctctaggggagaattcctttccttg

SEQ ID NO: 94455 - DNA, 349 bp, Homo sapiens
gattggtggaaggtctatgcaaagattgataacatggtaactgattagacatgttattttaaatgcagtccaagatttggatgaaaagctcacgttcaggttttttttgccttttgttgtaggtactcgataaatatttattgaggtagtgaaactaatctgaaattggatctgatacagagaatttgaccgattttacaaggtgtccatttactttttccccataagtattgtttaaataggctgttttattatcgactatcacacagatcttactgatttgcctcatttccttaaagatgtaaaataactgtgtttctctgtatgtttgtgttgctaaagaggaggt

SEQ ID NO: 94456 - DNA, 417 bp, Homo sapiens
tggtgcttgctcagcatgagcctgcgccatcgcatgtgcttgtattaacagattctcatgtgtccttgctatcgtactggttaataaccgtgacactgagttaggttttagtataggatcattgtgaaaattctgggcagggagatgctgatggaagagtgtggatgagaataaagaacttatcttgagaaggtacaataatgacttgctttgtttctctttcctcatcttgccagataacctcaggacagctgtttttattcagcccattgtattaataaacacagaaagacagctactcatgtaactgaatacacaggtatttctgtatttgaagttgataatacagtatcatagagaactcctttgtcccagaaaaaaaaaaaaaaaggagtgaaaaagagaggcagggtgccc

SEQ ID NO: 94457 - DNA, 373 bp, Homo sapiens
gaaaggcaacattttagcgggtaaagagggatacaagttctcactttgggccatggtttcaggcttttcagcttgagggtggggttttgctggggaatcacccttttctgcctagaatttctctggcttctgttcatatcagtaggatctgctccaacatgaggatagtaggaggagttatgagtcaaatatgatgtcagtgttttggggctggacaagcaaaatggtgatgctcttgatagaaaaatgaaactccatcagtggagaggataggtggcggggagcacggtcagctgagtgtggtgttgggcagcttgtgcgtgtgctgaataggtgctgatataccaagtctggccttttaaagacagacccg

SEQ ID NO: 94458 - DNA, 619 bp, Homo sapiens
ttggcttgcactgagagctgccctcccaccctctctccaaatttcctcttgggggtagcctaacaaggtgctgtcacagacccttgtcggccacgatgaccccacccagaccatccctctgctgtttcactctttgatagtctctggagctctctggggaggggtgagacctgccgtctagtttgtatggtttgcccaggtcttacagtcatggctggctgcctctctctgagaactagaactcctgaacttggtgaaagacctcagccatcgatcatgttgaattatcggggacactcatttgaaatccgagcctgttccagatagactctctctctttctgccctgaccgtgagagaagccctgctggacggtggagacactcgtgggctgtgagcaagggatgcaaaggctgccgggaatcccatctttccagcatcatctgccaaggcacattagttcctgggtatctggatgggttctagcagcattactgtcattgaaggaaaaattttagccatattaaaggttaatgcagcaatctccacataggctgcctggaagggaagcaggacaaggttaggttttccttgtgatggacaggaggcaggcggccctc

SEQ ID NO: 94459 - DNA, 208 bp, Homo sapiens
cggagctcacacggtaatgctctgacgggaggcggagctcacacggtaatgctgtgacgggaggcggagctcacacggtaatgctgtgacgggaggcggagctcacacggtaatgctgtgacgggaggcggagctcacacggtaatgctcggacgggaggcggagctcacacggtaatgctctggcgggaggcggagctcacacggta

SEQ ID NO: 94460 - DNA, 235 bp, Homo sapiens
gtaaccaacttccgttcatatatattaaaaataatcaggccagacacgatgcctcacacctgtaatcccagcactttgggaagccaaggcaggcggatcacctgaggtcaggagttctaagaccagcctggccaacatggtgaaaccccgtctctactaaaaaataaaaaataaatgtgctggacacagtggcaggtacctgtaatctgttgaggcaggggactcacttgagtcc

SEQ ID NO: 94461 - DNA, 548 bp, Homo sapiens
tcttccagtatcgtccgatcgaagtctgtcacgaatacggccgcagtggtcacaggcttggggagtcggttcttccctggcagctcccaggggcggtggtggtggggcctcagctgggagggtcccctctggctctcgatctccatcctctcctttaaccttcacaggcggtgacagtagcagggtctcagctgggagggtcccctctggctcttgatctccatcctctcctttaacctccacaggtggcgggggtggtggggcctcagctgggagggtcccctctggctctccatctccgtcctctcctttaacctccacaggtgacgacagtagcagggtctcagctgggagggtcccctctggctctggacctccatcctctcttttagcctccacaggcggctcctctccacttggcttttccgggcagagctcgtccttggcctcaaagctttccttaacaaatagctccatcttctgccttgtttctctgtccccgggaggctcctccttgccttccgcactggcgggcacattctcaccat

SEQ ID NO: 94462 - DNA, 379 bp, Homo sapiens
tgatacatggtacagtacagataaatcttgaaaacatgctaagtgaaataagttagacacaaagggacaaatattgtgtgattccacttatatgaggtacctagaacagtcaaattcatagaaacagaaagtagaatagaggttaccaaaggctgagggggaggcaatggaagttattgtttcatgggtacagcttttctatttgcggtgatgaaaagttttgggaatggatgataatgatggttgcacatcagtgtgaatgtacttaataccactgaactataccctagaatattaaatttataaattttatgttatgtatatttaggacaataaaaaaagagtgagacctatagagtcaggagttggaggtaggatc

SEQ ID NO: 94463 - DNA, 503 bp, Homo sapiens
gtatctcagaaatacacatgcagtatatttactttaaagtaaaaggatgtgttcatcgtcattgggaggtatcctctaacattgcattattctctttaacattcacagttatgctatccatatttatgagctgaaaagacagattactggcttgcatgagtccttgtttcttacatttgtcttctaagttttgtttggtgatgacattattgtgcaaggagctacagatggttttattttgatggggccaaggcctagccctgtgtcctcttccataggatgctaacatttctttctgcttttgttcttcctgagtcactgatgtacacaatacatcataatggattattcttcatcttgctcttgtcaaccaaagattaggtcattttgtcaccaaggaaaacttaaactgtgaaaaagaaatcctctatttcctagtggtgcctgataaatgttagtcataatgaattcgttaatagtctcccactttggaataatatgta

SEQ ID NO: 94464 - DNA, 597 bp, Homo sapiens
gacacagtgagatgctgtctcaaaaaaaaaaaaaaaaaaaatatctgggattcgaatcagccctctccagctccaagcacactgggatccttgccgttggaggttgctgttggcttctgcccgtgctgtgtattgagatctgcaaccaagcatgggagcttacgaaggcacctggtggtttctaggtaggaaaacagtgtggatgccagatgtggtgcctcacacacaacagcactttgggagcctgaggcaggcagatcacctgaggtcaggaattcgagaccagcctggccaacagagagaaaccctgtctctactaaaaaaatacaaaaaaaattagtcaggcatggtggtacctgtagtccctgctacttgggaggctgaggcacaagaatcacttgaacctgggaggcagaggttacagtgagctgagatggtgccgctgcactccagcctgggagacagagcaagactccatcttaaaaaaaagggccgggtgcagtggctcacgcctgcaatcccagcactttgggaggccaaggcgggcagttcacaaggtcaggagttcaagaccagcctggccaaaatagtgaaatg

SEQ ID NO: 94465 - DNA, 258 bp, Homo sapiens
agtgggaagattggcaggttttctgcagtttctgggtaatgggaagagtctttgtagtggagaagccacaaagaagtcaaaaggaaagatagaagggcctaccagacaggaaaaagctgaaggccatcaatatatgttgaaggaaaggaaatctaaggaaatcttggtcttagaacaggagctggcattcggtacctaaactgcagggtggctaggacattttgaggctgcaaagcaaactgtgggagtctctgtctg

SEQ ID NO: 94466 - DNA, 732 bp, Homo sapiens
ccactttttgaaagacaatctaatttaacaatctacatctacatcagtatggatatcagttttgcctttggtatttctcttttccccctgtctctctttgttcctgcctatctctattttagtctacgtcctctcagcttctgatgtcagactcctggggtttgaaactgagctcctcacttactggcttgtgatctgggccaagttacttaatctctttgtgctactggaaaagggcatgtaatgagttagtacctgccacatgcctaacacagagcctgaatcacagtgatgctcagcatgcgagggttgttattattattctattataattccctgggctgccatgaagggccagtgtttgagaaaggatggagacaagaccaggatatgggaggtgttgggttttagggggaaggttctccacctatcagggagcctctgaggactactgagtgaatgagtgatttgtcagagctggagtttagggcattctatgggcagcccagagcaggaaggaccatgggagagatggaggcagagccccacgtgggagccatcacagtcctggcccagcgatcccactggtcccaaggccagaacagagacctttgattccccatcacctaacccgccattcacagcatcctgaagcctacttatgtgtgaaggacgatggttctagaaacaggagggcccaagaacatcaagacagtctatacttttcagtgt

SEQ ID NO: 94467 - DNA, 429 bp, Homo sapiens
actgaaacctggcccccatgaaacactcactctccatccctggcaccagcgttcaagtcacttcttctctatgaacgggccacccgaggggcctcctgtgcatggagcctgcagcgtctgttctctgcggacggcttggtgcacttaccgcagtgccctccaggcgccccgtgctgcggcccccgtcagaatccccttccactgttaggctgaacgacatccacggcaccgtatgcgcggattgctttctgctcatccattcacccttccggggacttctgggttgtttccaccttctggctctagttctcagtcacctttgaagtgacccaggctccccggagccacgctgatctgatttggccatgacattcccatgccctcgggtgactcacagaagagatgcccgaacgccccaccctcctttcc

SEQ ID NO: 94468 - DNA, 411 bp, Homo sapiens
  misc_feature (318)..(318): n is a, c, g, or t
  misc_feature (342)..(342): n is a, c, g, or t
  misc_feature (361)..(361): n is a, c, g, or t
  misc_feature (370)..(370): n is a, c, g, or t
  misc_feature (386)..(386): n is a, c, g, or t
ggtgtaccttttttaaaaaaagatttttagttttgtctcgagacagggtcttgttcagtcacccagggtagattgaagtggcgtgatcatggcttactgtagcctcgagctcctgggctcaagagattgtctcccactttagcctctagctatcctcccaccttagcctatagagtagctgcgactatgggtgcatgccaccatacctggctgatttttttgttttttatgttttgtagagacctcgctatgttagccagggagtttgagaccagcctgggcaacatggtgaaaacctgttctctacaaaaaatacanaaattagggcacacgtctgtggtncctagctactcaggtaggnctgggagtngggaggattcacttgnagcctggggaggtttcaggctgggg

SEQ ID NO: 94469 - DNA, 333 bp, Homo sapiens
gttctcagactttacctggtatcagaatcatctgcagggcttgttaaaactcagatggctgggccttaccccagaaaaatttacatttctaacaggtttctaggtgatgctggtcaggcatacactttggcttaatgattctaggccaactggccattctgaggagaaatttgacagattttggcctggtattcctttctgcctctctgggtgaaaagattaattgcagatgggtttggggaaaaaaactctgaactttattttttgatacttagccacagggtggccccctagctccaataattactccatagcccccactcccaccgcatt

SEQ ID NO: 94470 - DNA, 217 bp, Homo sapiens
taaaattttatttaaatacattatgtattccttttacatggcttcttttactcaacatagtgcttctgagattcagtcatgtggtgtatatcaatagtttgtttttctggctgaatagtattctgttttatgcatataccatatttgtttatacctccatctgttactggacatttgagttgtttctgttacgttttctgaaacttggatttccaat

SEQ ID NO: 94471 - DNA, 314 bp, Homo sapiens
agggccagtcagagggtgagccaaggttccaacccaggcttccctccccagcctaggccgttccacactccctgttctgattttctaccgtgtccagaggaaactccatgtctgaggtttggtccgttgatgaggagctgcctgacctcctggctgtcacgaactcagggcagccctctgggaacgctacactcagccagagggcaaaggattgagcaggaggaaagcagccgcagggggctctttgatcatcctcaacccaggcagggacagctggacccggtgataatcctcctcctgtatttaggccactg

SEQ ID NO: 94472 - DNA, 275 bp, Homo sapiens
gtcataactttgcagcccagcccattcaagttatcattcttagggctctttccttctccacttctcttcctattctttccctcctgcatgaaaggccttatgaagcccaagccaggcttgtgaattacccatgacttctccatctccacagtgcctctcccctcagctactcactcactgaattctgctgttcttcttgtctttataatttctcatattcattttctctgtgttcttactgcctcttccctaattaaggctcccatgctctccct

SEQ ID NO: 94473 - DNA, 293 bp, Homo sapiens
ctgtggcccgttgggaagcccagatctaggggctccccaagccagggctgtgacaccttctttgggactgcacagttcctggtgtctccaagcttccgggtgccaccgtgttctcctagaacatttctagatgtgttacttaggaatgtggcagctgtcttgcttcttcatccagacatgggtccagaaatgggtgcctgcagcagaagccatgtgtggtacatctggtccagccacagactcacatggagctggcacctgtgccagtgcccggagctgtccatcctgtcgca

SEQ ID NO: 94474 - DNA, 154 bp, Homo sapiens
tgatagttcatgatgggtagctccagaaacaaacaaacaaaatgataataatgattataacctttcagccaaaaagaaaaaaaaaagcatattaactttactgttgtagtgccagtacaactttttattttatttttgagacaggttttccctc

SEQ ID NO: 94475 - DNA, 573 bp, Homo sapiens
ctgagccactgcttccagccccctttcctttcttatggatgactattttagaatgttgttttttgtgtaatcttagactttcctaccaaaggcagagggcccatggctgagggtccatgttcttcccagtactcagcacagtgcctggtacattcattcattcattcaacaaacatgtattgagcacctgataagtaccaggaactgtattaaaactaaacatagaaaatgaacaagaccagatctctatgctcccagagcttatatgatagtaagggagatagaaaagaaacaactattcattgtgaaactctctgctgtggtttgaatgttgtatcctcccagattcatgttgaatcctaatgttgaatcctatgttgaagcctaatccccaacatgattgtattaggaggtggcaactttgggaggtgattaggtcacgagagtagagtcctcatgggtagagtattagtgccctgatcaaagagaccccagggagctgccttgctccttcctccatgggaggacacagctggaaggcactatctatgaaccagaaagtggccttcacca

SEQ ID NO: 94476 - DNA, 1211 bp, Homo sapiens
gtttcatttgtcttttctaaaaaccaccttttgcttctttcattctattgtgtctatttgtttatttcattaatctttacttttatcttcattatttccttttttcttttttattttgatttaactttttttcccctagcttcttgagatagaccttggagtattgatttccaggcattttttttttgcttttctaatatattcaaccaaagctataaattttctctggaagtacagctttagagatattcttcaagttataacgtgtcatattttcattacaattcattctgaaacactttttaacttccattttgattttatatttgaacaatgggttatttagaaatgtatttttcagatcttaaacagcgggggatcattcagttatctttttgttatttgaagtccttgctagttactctgtgatcataacatttacatgattttatgttgaaaattttatttaggtttgtttcatggcccagaatatgaaatattttggcaagtattattttttacttggaaagaacatatatgcaaccattgttgggtatagagttctatgtatgtcagttaggtcaaatctgttgcttattttttatgttttttgtgacatttttcctgcgtattctatcagtttcgagaaaggtgtgttatgtattttgatgattattatggaatttctatcttttattgggtctatcaatttttgctttataaattttaagattatataattaagtatatgcacattaattttcttatgtgaattggccttttgttgtcattaaataaccttatttgtaacaatgtttcttgccttaaatcctattttgtctgatattagcctgtctttctttgcgtcatatttgtatggaatatattttccatctttctattttaaacattttacatccttatatttactgtgcatttcttataatcagcatatagtcattttttagttttgtggggaatttttagttgttttcttatttgtttttaccatccatcatgccaatattggtcttttaatttttgtccatttatattttatgtaattatttgtatattttggttcaaataggccaccatactatttgttttctgttcattctatatcttttaagttccttttttctctcctttcttgccctcttttatttaaaaggttaatctttctccaaagagataagaaaactgagcaa

SEQ ID NO: 94477 - DNA, 430 bp, Homo sapiens
atcctcccacctcagcctcttgagtagctgggactacagtcacatgctaccatgcttggctaatttttttgtattttttgtagataagaggttttgccatattgcctaggctggtctggagctcctagactcaagtgatcctcctgccttggcctcccaaagttctgggattgcagatgtgagctaaggcaaccggcctcacagaacacttttaactttaagatacttataaatttttcagatatctcagccatttcaagagtatggtaataatttctacttagcagtaggaactgaatcaaggtgttggtaggtggggctatgcaggattttgttgtcttctttattaaaaaaggtcttgtctatagtgagatttcttttaggcttagaatttaagttaattttgtagttcattttaggctgttcttta

SEQ ID NO: 94478 - DNA, 532 bp, Homo sapiens
gccttatctcggggaaagcacttccttccaagcaccatgaaggcctcccgtgctgagacaagatggaagctcctagtcccacctgaggactgatacggcctgtgcttctcggtctctcaggacgcgcaggcggccatgcgccccttcgacccctccgctctgctgcccacctgctgggattactggacctatgtgggctcgctcaccaccccgccgctgaccgagtcggtcacctggatcatccagaaggagcccgttgaagtggccccaagccagctctctgcatttcgtactctcctgttttctgcacttggtgaagaggagaagatgatggtgaacaactatcgcccacttcaacccttgatgaaccggaaggtctgggcgtccttccaggccactaatgagggcacaaggtcctagagacattaggtccacatgaatagcagaactgactttgaaggaaggaagcgttgtttcccaagtttcacaatgtgattgtacatgacttctgaaattaaaaagagagcatgaa

SEQ ID NO: 94479 - DNA, 205 bp, Homo sapiens
ctatgaatgtactgattttgtcagctaattttcagcgaactttctgagggcaaaggcaaagatttctcctcgccctacaggtgcatcagccaacaagaagtccctctatttgcaggtcctctttgtcctgtcaatttctttcttttaatttcttttttctttttttgagatggggtctggctctgtcgtgcagtgggaagatctc

SEQ ID NO: 94480 - DNA, 488 bp, Homo sapiens
acactagatagtttataagtccaaacaatgcataaaatacctatctcatgttaccattgtttaggttaccagataattgttctgtccaattattccacttaattttttgcttgcccattagctaaatggcaagataaaatttgtcaaacgggggggaatgtattgaaaatgctagacaactacacttaaaatgaaaacaggccaggcgcggtggctcaggcctgtaatcccagcactttgggaggccaaggcgggtggatcacctgaggtcgggagttcaagaccagcttgaccaacatggagaaactccatctctactaaaaatacaaaattagccgggcatggtggcacatacctgtaatcccaactactggggaggctgaggcagaagaatcgtttgaacccaggaggcggtggttgcagtgagccgagattgtgccactgtattctagcctaggcaacatgagcgaaactccatctcaaaaaaa

SEQ ID NO: 94481 - DNA, 466 bp, Homo sapiens
ctaactgcagagcccatgctcttacttcctaccctctgtggtatcatctcagagccaagcacataaaatgcaagcttttgtgctgctccttttcgtcaaagatgtgtgtcctccagtttcaagggactaaacacaaagtagttccctggaagtagaatcagaaggctttagaattaatttttttaagtcaaagtgcctctttgaaattatttttagaaaggaaactttcattaaatatgttttccttgatatataaatttggggtcagagggattaggctttgagaatatgtgtgtgtatgcatgacccagtctgtgttgatagccatgatactgatttatccaccttgtcacactagttccttttatgattaagcacacaccttgcatgaggtcagtgaccatggaacacagggaaaccgctcccatggctgatttgagcctatgatcttagcctcaattacatt

SEQ ID NO: 94482 - DNA, 384 bp, Homo sapiens
atcagacattcacatgcttatgaatgaaggaccccttgtaatacttctgcccctgccccccattccacacaccaccccctccccaggagtagggattagaaatcgttagtctttccattttgtcttctgtggtttcagttaaagttctaaagacgtattttactaaaagtggaattgactttttgtattcaggggaacttgtcagtggttttcatattatgtgccgtggagtcccaggattccagaagatgcctcaagggagacccctcccttcccccgtatcccttccagctttaagcagcctgtctgctttaagctcttatatatattgagattctccatgagatttcatttgtataaatgatttcacagcttaccaaaaaa

SEQ ID NO: 94483 - DNA, 174 bp, Homo sapiens
tagtcgcaaaatgttttatttgtaataaacttaaaatcgtcccttctgttcacacgctggtccttttctctcccacttcttgcaaggccttcagagctcctccccaaaactaaggaggtgctaaaggatgtgagaaaatgacaatccagaacatttctgagtgggcttaggtgt

SEQ ID NO: 94484 - DNA, 840 bp, Homo sapiens
attctgattattacgtttaacctagatttatttgccaggttgctttcattttcttatttatatgtgaaatgtaaactagcagggttgtgtgtttaatttttttttaactttgcaaatggttgtggtatattctgaaacagttcaaaatatagctaagtagatttatttctcttttttggtgccattagtccatctttcaactctttttttttggagacagggccttgctctgtcacccaggccggaggggcagtggcgtaatttcagctcattgcagcatcagcctcccgagttcaagtgattctcctgcctctgcctcctgagtagctggaactacaggcatgtgcttccacacctggctaatttttgtgtttttagtggagatatggttttaccaggttggccaggctggtctcaaactcttgacctcaagtgatccacctgacttggcctcccaaagtgttgggattacaggcgtgagcaactgcccccgacccatctttcaactcttataatcactttcaacaattataaaattgtcagtaaactcttgaatttaaaatgaaacatttttagtgatgtcaaatggcatcttgaaagaaaattgaattttcttagctgacatggctttatattttcagttttggaaactatggggtacagcttatccttttgtctatggtatcatttatcatacgttttggaacatgtcattttagaatgtattttctctaaatactgacaaatttgcctttaaataccatctgttgatgtttaagatacccctttagtacactaaagtcaaatgtatacaaggagtttatcataacttgtgtgata

SEQ ID NO: 94485 - DNA, 385 bp, Homo sapiens
acattttgcagttttaatccaaccaagctacttaaagcaaaacaaacaaaaaagtcactctttggaggaatataacaaaatctgactatccatgagataatgttggcaatgtccaggatataattcagaattaacaccaccagtgagcagcagatgtacatcctgcacctctagatgtgatacccggagaagcatcatcaccattataacatttcatccaagaacccgtagtcttaaggacatacacacaaaagtttttattactaaaaaaacaagaaaggaggagaatatattatccaaaaatggcaatgtcataaaagtcaaagcgagaggaaatgttccagattaaaggagactaaagagttacaagtaagtgaaatgtgtg

SEQ ID NO: 94486 - DNA, 248 bp, Homo sapiens
aggtttacctgctcctgttgccatttttatttagtacaaatttattaacatttaaaaatcattggcacttatgaaacttgaaactttattttactgttaggaagattttggctgcaagaaatataaaaaccaatgctaagtggtttaaatcataagaacacttaacacttcatggatgaatatgaaaatatggtggttcaggattagttgaattagtagttcaataatggcctcaaagactcaggatc

SEQ ID NO: 94487 - DNA, 585 bp, Homo sapiens
gggattgtagagtaaggatagattttgttatttcttgtaaactgtctgagaaatcctttgagagtgtgtggtagtaggatagtaaagtagataaactggcgattctggttcctgtagcagtggccattcctaaccctataagtaaggttattagttgtatggccctgcactgacagacttcagctttgaggggcactaatatggtctgatttcctcaagattagaagttaggataatacatgttacactgttaacttttagcaagctttacttttgtcaaaaaccttgtaagtttgggatttcaattattctttgctattaataagacctcgttcagtccatattaacttagaattggtatagatggctcctttctgatgctgtaagtactttaaggtttggctgagtgcaaacagctcacacgtttgagcagaccaattattaagcaactttcctaactctgcttctacaagagtttccttatcacttactgaatacccattgtgtctttttcccttaatagctttggaggaaccatctatcatcctatcccaaaggggttcctcctaggtctgttcagatctt

SEQ ID NO: 94488 - DNA, 227 bp, Homo sapiens
tccaggctctatcactgcactactgaattgtattatgttgccggttatgctccttatggctcagtctcttgaagccctgatgccagtggctggcccctgggaggtgctctgctgatgtgtgcaggagggaatgaagtgtcctcaggattcgtgacttccctctgctcctggctggtggcaccttctcccgcattctcctccgcgtcaccctcactgctcttttccta

SEQ ID NO: 94489 - DNA, 349 bp, Homo sapiens
aaaaaaacttgattctggcaatagagggatagaggattaattctttgaagtttttgacatataaaagggattgtggggtctccttttattggaaagacagagaattaacaccttaactgaatccatattgtaataaaccctaggacttggaaacaatgttgcaaatattaagtatcgtataaatttatctctatggaaaacatcttcaacttcattaaatgttctgtatgatgccacttatctatttcatgcacccccataccttctccaaaagttctctagacaatgttgcactgagaccacagagatggcatttttaatgtcaaaacaaaataacgtagcagaaacc

SEQ ID NO: 94490 - DNA, 196 bp, Homo sapiens
tacactgcacccagagctccccaccttgcctggaccccctgaccaggaagggccgagtgtgggtaatcatcagttgaatgtctgcatggcccccacttttattataaatctacaatgtatcataggaagccttactgttcatccacccctcacgttatagacagggaaaccaaggccctgggaggagatgggtcct

SEQ ID NO: 94491 - DNA, 374 bp, Homo sapiens
tggctggccatggtgtttattcgatggcaggtattaccaggatggagcgagtcccagtaggaagggcctttaggatgtcatctggttccacccaacagggatgggaactgtaattccccactctccctgtggagaatcagggcgggctccggatggatggccaaaggctgcacagaggtgagcctccagggttgggttctaagcgctgttcacactcctgtcccagtggtgtttggtctggggcacattgtgatatgtgtttccctcctttcttaaaattagctcttggcttcagggccttgtagtggactgatgtccctccttaactgaacagtcagtctgcttatttttttggggtggtttaggggtaaaaa

SEQ ID NO: 94492 - DNA, 273 bp, Homo sapiens
ccttttcctctaaaactcccacatattcaaattagatgttgctggcatacaggggaagtttttaaatgtaataactgcctgtttacttcttggaactataaacaaagcttagaagaacagggatgtctatcttgttggcatttagtgttcttacaggaaaattaaagtctcacaaagacacagttcagtgagccaattaagccttgtctattaaacttatgcaaaatatatggcaataattctgatagctattgttaattcaaagcataggct

SEQ ID NO: 94493 - DNA, 265 bp, Homo sapiens
accagaagaaatagctaacagagtgaaaagtaattgtctggggaggtagcaggtggggtggaacatgggtattaagaaggattctttttttaattctaagcattctattactacttgactttttaaactatgtatttgttagatacaaataaaaataaagttctttgggaacaatgactacctaattctcttatatgaataaacttttctattgttggcccttggtttgtttctaattataaatggttcaataaattttttaagt

SEQ ID NO: 94494 - DNA, 404 bp, Homo sapiens
caataggttcttggaaactgcaactttaagcgaaatcccagataaggaaaccaattttaccataggctaattgatgtaaacaagagtgaagttcctacagtgtccaaaacatcaccaaatttctaaataaagcccaaaacacttctcatattaagcattgaaataaatgtgaactatatatacatacatttcagaaaaagtaattaaaacaagtaaggggcagggcgtggtggctcacgcctgtaatcccagcactttggaaggccgagacaggtggatcatgatgtcaggtgtttgagaccagcctgaccaacatggtgaaaccccatctctactaaaaatacaaaaactagctgggcatggtggctggcacttgtaatcccatctactcgggaggctgaggc

SEQ ID NO: 94495 - DNA, 188 bp, Homo sapiens
ggaaaagctcagaagcctctagatgggccagggtgccacagaagtgagctagacaggtgggcctgcaggccgccgggccaggaaagtggaggaagagcaggtgtgggagactggaggggtggaggtcaggatctagcagggcctgggctgggggcagtctcttcaagagtgctgtgatgatgcagggg

SEQ ID NO: 94496 - DNA, 483 bp, Homo sapiens
gtgtgtgtatctcagcaaagtccactgttgtaagcagaataatggccccctgaaagatctgcacgtcctgtttcctagaacctctgactatgttacttcacaaggcaaaagaactgagtgtgatgaagttttggatcttgagatggggagattcctggattatgtgtggttggcctagtgtgatcacaagaggcagaagggtcagaatcctataaggagtataaggagatttgacaacaaacccagaaagagagagatgaacatgtcttactgctggcttgaagatggaagaaagaaaagtaggtggcacctagaagctggaaatggtcagcaaacgtcctccccaagagcttctggaaggaacccacactactgaaacccttcacttaggacttacgacctccagaactctgagataacaagtttgcactgtctcaagccactatggggtggcagtttgttaaagcagctttaacaatagat

SEQ ID NO: 94497 - DNA, 641 bp, Homo sapiens
ttgtcttcaaacattaccatcataaaatcagatggttcatagttactgcaataggaacatatagtagagttgcaacatgtaacagaaagagataaatggaagaagtatgggtgactccatccaccattcaactcaatgagtgaatgccttggagtgagcatgaagagtgagacatgactccactgagcccttggtcggtcacagtacatgtgtacctttcatagtatgaccatctgacaacactatgtggtaatttcatctaagaaacacgtatatttttcatacaaagcacaaacattgccaaacacaagtcaacttgtttatcgactccccatttgattcaacagcaatctatcccaacaatgaaagtaaagtgataggggttaaaatctttgagatagggtatgaatgtctccaatgtggcaggaatatatggctctaaatgcacataaaatcaatacagacaaatccatgtagaccattaaattatgaggaatttatgagatttttttaaagtaatttggtcacatgcaatattcaaccttttaggctgaacttggaacataaccccctcctgaaatgtcactccactgggatgaaatacactgagtttatcttagtagtaggatttatttcactgg

SEQ ID NO: 94498 - DNA, 919 bp, Homo sapiens
cctcagcctcccaaagtgttaaaattacaggcatgagccaccacacctggccttttttattaaaaaaaattttttttaaatgcaatgttttctttttttgttgttgttttagcttgtgtctattctccaaagcatgttgtactgattgtgtagtacaattttatttaaaaatgtatgttaagatttacataaatatttggggtgtccatgaatcaagaaatacatgaaagtatgggcaccaaaacgttaaaagtggttttgttgggagttcaggggattttactttctccctaatactttattctttgaatatcttgaaatggatattttgtaactgtataaggagaaaggaagcgaaactatttttctgcaggggtacacccacatctattgtattagacaaatcacagagggattgcaacagaacacagatttttctcactgttttttctctggttgatcgggatgcattatccaccagaaaacactgtagacgactcactcaccaggaaaagagcatatgccagttggaataaataaaggggaagagtaaggaagaggctgtagaattattttataaattatcaagtcttatgagccaggtgcagtggtgcatgcctatgtacagtcccagctactcaggaggctgaggtggtaggatagcttgagcccaggagttcgagggtggagtgtgatatgatcgtctgtgaatagccacagcactgcatcctggacaagatagggtctctttaaaaataagacttaactagcactttaataatcattgtttttgttcccaactgcattgtacattcattgaggacagggactttaaacttcattatattgctgttgctgtgtttcacctttgaatgatttttaaataaaaatctcatctttgagtcacaatctgatgtaa

SEQ ID NO: 94499 - DNA, 440 bp, Homo sapiens
caaataggtagcataggactgaaaagtttctctattgcctgacatttcattgagcaccacattttataactgaagtgcttaataggtcttaattcatttttactttaggatctaaggtaaacgataaactctagataattaaccaacctaagtcatctgttgagtaaaaataaaaaatcaaactgacacaactatctttttgtatctgtgtagtaacaactgtgctggattaattatctaaacagctactgagatatttaaaattatctatcacttaactgcttatatatacacccagaaacctaatagttttaagcaggacaaatggcagtgtgggaagatgctgaagaaacattctagacacatcagaaaacaccacagaccagcagtttccaacagaaatacagtgtaattataattctagtaaccatattacagtc

SEQ ID NO: 94500 - DNA, 345 bp, Homo sapiens
cggttctgggtaggatcccagaactggttgagccagattaccggtctgggtggcactagctggtgcatcagaacactgggtctgcaaaatattccaagcactgatcttagtttttacaacagtgatcttatccccaggagcagttttgggaggttcagaatcttgtagcctccggcctgcgtgacccctaaaccataatttctaatcttgtagctaatttgttagccttacaaaggtagtatagtccccaggcaagaagggggtttgttttgggaaagggctattaccatttttgtttcaaagttaaactataaactaagttcctcccgaagttagttcagccca

SEQ ID NO: 94501 - DNA, 487 bp, Homo sapiens
ggtccaagtgcgttctgctcactgatacttttaaccctcataataacctagatctggattgctaagattgagtcttagttctgctgagcagtggtgaccttgcacaagttacttaacctctctgtgactcagaaagacacagtggagaaagtatgtgactgacctcaaaatgttgttttaagcaaataaggctaaatatgcaatgctcttaagagtagttctgggtacatgataagcacctccgtcccagtgttagctgttactgtcccattgtcctgaagccaggcgattacctaagagcacacagtgcactgctgggcagagctggggcttcgggctttttgacgagtaggctgcagtgccttgggacagaagcagcagctgcaagataccatcactgtgttcggggtatgttgcagagaaggagctccttatggcaaggcattctttcagtggctgcaggccatagctgcatgcaggcaaacgc

SEQ ID NO: 94502 - DNA, 202 bp, Homo sapiens
tgcatgacttatgatgacataaccttgagcaagaagtgagctcaacattagttctgagacttcctgtctacccatagtggaaaacacaatgagttccatgagtgacattgttcattttggctagcgacatttcagagaaatttatccatgagatcctcataatacagattctaaaaacagtgatcagcacaagaaataacat

SEQ ID NO: 94503 - DNA, 420 bp, Homo sapiens
cgagattacagtgaggtatgaccgcatcaccgcactccagcctgggcaacagagtgagaccctacctccaaaataacagcaacaaaaaaggaatacaattctgatacatgctgcgacacaggtggaccttgaaggcattgttaagttcaataagccagtcacaaaaagacaaatgctatatgattccaattatatgaggtatcgaaagtcatcaaattcatagaaacagaaaatatagtggtggttaccaggagctgtggggaaggggaaaaagaggttgttgcttagtaagtgtagagtttcagatttgcaagatgagaatgttcagtagatctcttttgcaacaatgtgcgtaatgtttaataccactgaactgtgcacttaaaagcggcaaagatggtaaactaaaggtttttttat

SEQ ID NO: 94504 - DNA, 216 bp, Homo sapiens
acatgctattcattgtaagacgcatcattattttatctactactaaagaggaaaaaataactaattaaaccatgacacaccattgattgtaagaagaatcccattcagagatgttaaaatatgaaaaaatgagaaaatatgaaatatattaataagcagttaagttattcctgtgtaaatgtttacaaccatggactgctaggatacacttccttt

SEQ ID NO: 94505 - DNA, 759 bp, Homo sapiens
ttttttgacttacaatgttttttgctttgcagaattgatttttttttgcatttgaacttatcaatcttttctcttatggctttattattattttttttagagacaggatctagctttcttgcccagactggattgcagtggcatgatcatagctcactgtaacctcaaactcttgacctcaagtgatcctcctgctttagtcacctgaatagctgggaccaccggcatgcaccaccatgcaagttccatgcataagttttatatctacagtaaatatttcaagacttaaactgaaaatttaatgaaaaatataatgtatagatattatggataaaataggaaaaaaacttacacctaaaactttgtcaagtttaaaaagctaaatttgaaatcctgttagaaaagcgggtcttgtattttgtatgtgtacaaaatattttgttttgggctctaagcatatgcagatagtgtgacctgatgttaattaatctggacagaattaagaatgaaggtatagagagggctctaaggcttaaagtgacagttttatgattcttaagtgatgcttgtataagtctgtgagttttgcttctacaatctttgaatgcttgctgatgagtggcctaaaatctcaaaaaaggctgggggcagtggctcatgcttgtaatctcagcactttgggaggctcaggcgggtggatcgcttgagcccagaagttcaagactagcctgggcaacatggtgaaaccccatctctacc

SEQ ID NO: 94506 - DNA, 272 bp, Homo sapiens
ggcaaaggaaaagaaaatgcgtcatcccaggactgcagaagcctgtgatgaattatccacagggctgctcccaagagcccgagcagagggctttttcggcagagttcctgcatccagcctaccgatgccctggaagaggaattcttaccccccttccccaaattaataaaatccaccaagccagagagcaggaatgcagcattgcaggacagcagtagctgccgggtgttccctcagcctgccctcgggcttccctataccggtctattttt

SEQ ID NO: 94507 - DNA, 136 bp, Homo sapiens
tcttaattacagcctgggagcctgaataaaaataataggtagactcagagtggatcttggatggaaggtcaagaaatcaagtataataatgttatacaaagtaactggagattaaaggaaagaacccccttatttt

SEQ ID NO: 94508 - DNA, 475 bp, Homo sapiens
tgaaacaagaagagaagaggctgaatcggaggcgcttctcatgaccacacccaggagtccgggccctgggccttttctgggtgctgggaagagcatggctgcccgtgctgaatgtccttgtcttctgtccccggtgcctgagacctctgcctactcaacccatcttttaactctcaaggacatgacctacagggagcttctttgcccccacactgggcaaggcctccctgtgacagcctcaacttcacctgcttcatcactttgttacatttacatatttttttttccttttgagacagggtctcattcctttgtccagcctgggagtgcagtggtgcaaatgtggctcaactgcagccttgacctccaggtctcaagtgatcctcctgagtagctgggaccacaggcacacatcaccacatctggctaattattattattattattattattattttaagtagggacaaggtct

SEQ ID NO: 94509 - DNA, 585 bp, Homo sapiens
cccaagtagctggaattaccggcacccaccaccatgcccagctaatttttgtatttttagtagagatggggtttcaccatgttggccaggctggtcttgaactcctgacctcagatgatccgcctgcctcaacctcccaaagtgctgggattacaggtgtgagccactgcgcctggccaagaaccacaacatagtttaatggaaaatatttcttgtacaatttgtgttcatctttagaagaaatttttctcttctgaagaaagaaaatacaaatacaaatctcttgagcatatctttaatcagtatttactaaagaacattaacttaagtgatgccattttgtccaaaatataagctaaactcttgacaaacttcaacatgtttcggaagcagaaataagggcctgttggaggtttctatttagtttcaaaggaaagcacagcaaatcagaatcctggaagattagaccacccaggagttctgccaaggtgaagcttttatgaatcctggattgtcttacgttttatttccattcacttgttctgaggaaatctaactcatcaggagacttgaagataatgagta

SEQ ID NO: 94510 - DNA, 478 bp, Homo sapiens
ttcaccacacccctcctcccaacttaacatttctgaaatgagatatatcttaaaaatcaatgtttacatatttaatgttctcatagtaggctttcctcactcctcagagaagctgttaatacattgatggtgtatggagaatcgaagaattacagtattacctttttaagaaattgaacagaagaagaaaaggaatgcttaatttccttggagatttcttggaaaaggtggtcaccactcttgcttattctaattctcattatttatctttctatgaattccttctccatcaagttcctcaaaaatggtggcactcctgaggctaaaagttcagctgttatcatgttcactcaggccattgtcagttctctgaaatcttctctttcccaccactcctacttattttccctctccttcccaccacccaaccagtttatgcgagagtgctgttttgtaaatgagactgggagctcataaa

SEQ ID NO: 94511 - DNA, 680 bp, Homo sapiens
aaaagaaaacagtatctggtaatgaaatcagtcacgaaggaagcggacttctcctgacttaccaatgtgacaagaagcaccacagatgtagtcaagtccaattctcttacttcacacatgaggatactgaggactgggaggagtgtattcatgttacattcgggattagaactcagttttccttcgtcaccaatttcaaacattcagtgaaaatgatgatacaatgaacaccctatacccaccactacattgattcaatgattaacattttgtcatatttgctgactgtatttgcaaaaccatttaaacgtaatttgtacaccttgtgacaattcatctctaaagatttcagcatatatttcctaagatcaggatattcttttatatacccacaataccattataaaaataactaaaaataattccttaatgtatctaatacctagtccattttctaaattttgaaatgtgtgtctcaaaatgtcttttataatttttttcctcaaattacaatctagtcaagatatctcattgcattcattttatctttatcatctctgttcgtctggaacattctccaaacacttctttttgggatgttaactttttgtaaaatgccccatggcacactagggaaagtggcatacaaagctgaggcctgaaggtgaataagtatgtgt

SEQ ID NO: 94512 - DNA, 666 bp, Homo sapiens
atgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatac

SEQ ID NO: 94513 - DNA, 560 bp, Homo sapiens
gatgtttattttattaatctattttttaactgggtagggattgcttttgtaattagaaaaagtattaaaaactctctttaattaggaagattatgtaaagctgtaaagcaaatttattttgcatttcagaggctgtttctttatcttgctctctctcctgtggcagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcc

SEQ ID NO: 94514 - DNA, 258 bp, Homo sapiens
aagactacagagaaatggcctccccctttgacccctcctccttgggggacaccattgttagatattttgcgggggctcacctccttaggtcagtctgtatgtgcctggagaaattgctgtattttataggtctctgtctctctatcacaaacataaaaggatcccactgtatacattaacctacaacttggttttttcccctcacaatacaccgtgaggctctgtccacattggtctgcatacatctgctcattcatt

SEQ ID NO: 94515 - DNA, 360 bp, Homo sapiens
actaacccagcctttggtgccctgctgggaagtgtcaagcgtggagacagttatggaaactagaaagccctttttcatgtttgcctagtgatgagaggaagagatgagattgttgctttttcatatctctcccgtggactcttaaaattaacttcactgtcaaaatttcccatggcccaaatgtaggtttggggagagaaatgtaagactttgaagttgagaaagaaagtagagaaagcattctctagacaaatgctcaccatgcagacttcagaatctgtgaggagacaaataaaaaggcactcggggaaccgttttagagagaaaataaagaactgggagtagagatggctacttcag

SEQ ID NO: 94516 - DNA, 557 bp, Homo sapiens
gtaatgaaaccataagacatgggtcccaacttcagaatgcttcacatttggttgtggaaacaggtcacatgtatcatgttaagtaatggagataaaaagtttgcaattaactttttttagtgatttcttttttttttattagtgaaatttaaaatctatttccccaaagtaatctttggagttcaacctaattttagtgataatatatgtgccagatttaatgctgtttctccttcccaccgctcccgcctccccaaccccaaccttccgtacattagttgaaagggccctgcaggaaggttctgaagtcccaggcaaatgtaatagggggtaggcagaggacttacttagagagatggtggtgaaagtctcaaactgcagatttctagaacaaacaggttacttgtaagaagcagacagagatacttagatcagtaaaatacttctgtaacactagaagtgagaagacatgagaacgttatctagaaactatcaagaggaaatgactgcagaccaaaaatcctacgcatagtagtcaaataaaaaatgtcaaggga

SEQ ID NO: 94517 - DNA, 697 bp, Homo sapiens
acaccgtggttgaaattgtataaacgaggaatagtaaattacaaaatcttggttgatgatacagaagtgcttacagaacatagtcactccaaagaccctttcactccacttatcaacagtaattattgtcctcaggtttaactggctaggtgaaacaagtatagaacaaaagcagcctctgcttgtatctgaagccctttagttagtgttcatagcaggtaaatgctctagtaaagggacagcttctattccaatcccgaggtatttcaatcactgttggttcttgttcttctcgagacagagtctcgactgtgttgcccaggctggagtgcagtggtgtgatctcggctcactgcaaactccacctccgtgggttcaggtgattctcatgccatcagtcacctgagtagctgggactgcaggaacatgccatcacagcctggactaattttaatagtatatttattattttaggtaaagacagggtatcaccatttgggccagactggtctcgaacttctgacctcaggtgattcccctgccttggatctgcccgaagtgctggggtactacatggcatgaaccactcgaacccggtccagttaggtatcctaaaatttccttatcaggtaaagtttaaagagcatagttactgcccaaaggtttcgttgtgtggcactgattatcggatcaagaa

SEQ ID NO: 94518 - DNA, 460 bp, Homo sapiens
acctcactctccaaccaagtgcaaaattaaatagaattcttgtgatatcaggggaaacaaaatatctccctgaccttctctagatgtctgtactatcagttcacgagtttctgtctctaaagcatagtccctgtttctcctgatgttttctctctttctggcaaaaaagaatgttattgcatattacaaataatttttgttagtttctactcaaaattttaacatatttgtagtgagaaagatgttacaatatttatttcaccatcctgccagaacaagatgtcaaggtggtgttttctaaaacacaaatgggtgtgtcacactcctacttaaaatcttcaatgactttatatttctattatcataaaattccatctccttcatatgacataaaaggaaatcctacctttcaagtctaaccctttgctatggtctccttcacactcagttttcagctata

SEQ ID NO: 94519 - DNA, 370 bp, Homo sapiens
gaatttcttctttattggcaccctggctcttcgttcactcacatgttggaaatgttctcttaacatctgtatgttgtcttccttgggagctgatgttgaattctaaaatatttggaaccatccctataaattttctgccagattcttccctccccttccccccaccccccactctttttttcatctaggtgtatgtatgctgctatttccgagacatacattccttacacaatcatgaaaaaaagttttcctagacacccatcatcccttactgcttcatcccccattttgctttctaaatgtcatctcttccttttttttttttgagttggagtcttgctctgttgcacaggctggagtgcagtggcgt

SEQ ID NO: 94520 - DNA, 546 bp, Homo sapiens
agttaccaatctgaagtgggttccattattgtccccatttcacagatggggaaactgaggcacagagagcacaggtcacttccccaaggccacacagctagtaggtggcagagctacgttcaaactcagctctcctgggcccagtccctgctcccaacccatagcacactgtggctgtgctgcacgcaccgttcaagaggcgccctcgtcagtgggatctctggctgcatgttcgtccacgccagcggtttcactggtggtcaccacactcaacagggtgccttaagcatggcccgtgccaccttggcccagtgctcatacctcccacaaatctcctagtctaataaaaccttccaactcaaaaaaaaaaaaagagggggcctcaggtggccttgagaagggggtagatggcatccagataaaataacaataaccacagcagtaagagtaactagggcacgtcgcctcccggagcgctgcccctctggcaggcactaaggacctcacaggtaatcactcgttcactcctcataggacctcttggat

SEQ ID NO: 94521 - DNA, 320 bp, Homo sapiens
ctgggattacaggcatgcgcgaccatgcctggctaatttttgtatttttagtagatacagggtttcaccatgttggccaggctggtctcgaactcctgacctcaagcgatccgcctgcctgggcctccaaagtgttgggattacaggcgtgagccaccgcgcccggcctaatattggctagtattttcagtacaacgtttattaaatggtgaaaaatggtttcctgtctcattcttttttttttttttttttttcaagacagagtcttactgtgtcacccaggctggagtgcagtggcgtgattttggctcactgcaacc

SEQ ID NO: 94522 - DNA, 785 bp, Homo sapiens
cccaaacccagaggatccaggcttccagcacgggatggggttctgaatggggaaggaggaaggaagctgcctgctctctgcctgggcccctgtactaccctcaccccagcatggtcactccattcaacctacttctgtttccaaggcgtcttactgtgcccagcaccctgaggaagagagaggatcagagacatcccaacctcctgttggacaaattctcttacttccacatttctgccttggctccttagagaactcttccaaggcctcagctggatcccctgagctctgacctgccaatcacaccaaggctgctcgccacgaaaaagaactgactttgcctcctctccctccctgtccaaatccatcccaggctttcctgtgcagctaagtccttcccagagagacatcaagatgaaagaaagcagacagacctggattcaaacttcatctctactctttatgactttgggcaagttgcttactctctttgagtctcggtttcttgatctgtaactgggaaagcaggtgcatccttgccgaggtgttgtgaggatttaataaggtgcgacttggagagcaccctgccctccctccctggcaggtgtacagagagcttgtcagaccataactcaaaagccacgtggccaccattgcccattgacactacctccgaaacctctctcccgttcagctcctctttctatccccattgtcacagccctagtctaagcccctggtttcccacctgaattcatttaaacaacgaattcattgaccctctt

SEQ ID NO: 94523 - DNA, 964 bp, Homo sapiens
ctctacaaaaaatacaaaaatcagctgagtgtggtggcaggcacctgtagtcatagctactcaggaggctgaggtgggagaatcacctgagctcaggaggttgagatagcagtgaaccatgattgcgccactgcactccagcctgaatgacagagtaagaccctatctcaaaaaaaaaaaggggaggtttatttaacaggtaacatagattatttaacaagtagtataggttaattctaagcacacaacatttatcaaaatctcaggaaaaaaatgtgttgaggaagtattgaaaagtacagtttattttttgagattttgagattattacaaattattcatttgtcaaactattgaacagactaggtgtctggaaaaaacgatacccttgtagaatttatttattgttttagcattttcaacttaatttgagggaggttataagaaacatgtaagaaacacattttctattagaaggatattacattgtttgttatattcttttattgggatctttggaaggaattgtttatattatgcagtaatccctccttattcatggttttgcttttcatggttttggtcatctgtggtctgaaaatattaagtggaaaattacagaaacaaacaattcataagtttgaaatctgacaccattcagctccatccctcccgggatgtgaattattcctttgtccagtgtatccatgatttatgggccacctgcccaatagtcacttagtagcagcctcagttatgagacctattgtcctggtatcaagctgcttgttttcaagaaactctattttccttaataatggccccaaagtgcaaaagttatggggttggccacttgtgtatgccagagagaagtccttcctttaagtgaaaaggtaaaagttcttgacttaataaggaaagaccaaaaactgtgtgctgaggtttttgagatctataataagaa

SEQ ID NO: 94524 - DNA, 411 bp, Homo sapiens
ccacagtagtgattgatgtgatgtaataaagtgaagcgagtggtcaaggaaggcctctctgtgagaagttgccatctgaccaagacctgaatggtaagaaggcactaaccttgcaaagacaggtcagaaaagcatcccaggcaagaagagctgcttgtgcaaaggccctgtggcaggaatcacattgccccatgcaagaaactgagagaagccagcatggctggagcttggagggcgcaaggacaagaatggaacaagtcacagtcagagagagagtccagggcatgctcacggagagctctgaaggccaaaagaaggagcctgaagcacattctaagcatgataggaagcggctgcagggtttgaagccagagtgacatggtgagatttgcttgtaaagaccactctggc

SEQ ID NO: 94525 - DNA, 411 bp, Homo sapiens
aaaaaaaaaaaaaaaaaaaaaaaagtcttaacattgggggtaataaactatatgagattaataataatttctgaagttatcgacattaaacagtgccagaatgagtggcacttaaaacacagcaacagaaactcagatttgaacaattatgagtaggaagatattctaaataggaaagccatcatttactctcaggtacaatttgagggaacaaataaggaaaccaggctagtgacagggaagtgaaacatgaatgtataaagccacattgtggaaggcaattaatgtttaaatttgttatttattcttgtgcatctcttcacatgaaccatattgacagccattgttgacctttgggtgtatttacttgtagtcttttatttaatacttattgtatatatgtactcacta

SEQ ID NO: 94526 - DNA, 494 bp, Homo sapiens
gtatcttagtattttcttttctctatgctataaaaaataatacttcgaaaaaatttcaaattccaattgctcattcctagtacatagaaatgcaattaacttttgagtgctgacttcatacttgcaatcttgctaaatgtatttgttagttctaggagtatgcgtttttttttttctttaatgttctttaggatattctacaaagacaatcctgtcatctgtgaacagatgcagtctcacatcgccccctcccctctgaatgtagcaacacagactccatcgctacaaaacataaaaaaaatttggctggacatgatggcttgtgcctgtagtcctagctacttcaggaggctaaagtgggaagatcacttaggcccaggagatcaagtcaatagtaagctatgattgtgccactgcactccagtctgaatggcaggccttatctcaaaaaatataaataaaatgaaagagggctttatcagttttcatccaag

SEQ ID NO: 94527 - DNA, 221 bp, Homo sapiens
caccctactcactttacagatgacagcgtgaagtctcagcgaagttaaataattggctccaatgcacccagccacaaagagctcaagtcacagccgcgacctaggtgtgcctgattccaaagggtttttgttttttgtttgtttgttttgttttgttttgtttttgagatggagtctcactctgtcacccagtctggagtgcaatggcacaatctcggctc

SEQ ID NO: 94528 - DNA, 272 bp, Homo sapiens
tggtaggtgggtacaggtgggtgcaggtgggtgatgggtggtaggtaggtgggtgcaggtgagtgggtggcaggtaggtgggtgcagatgggtggttggtaggtgggtgtgggtcgtgatgccttccctcagctccccccactggtccctctcattgtcagtggggcttgtcacccacatcctcaaattctgtgatccacaggggcagaagcaagtcaggagggcacctgctggccctgagctcttctcaccctccctgcacagcccttgag

SEQ ID NO: 94529 - DNA, 303 bp, Homo sapiens
ccccacccaggattcactgaacatttatggcctgagtcccttccacatgctgggttaacaatcacaaaaccacatgatactatagttcaggagttaccgagctctggaaatgaaagggcacaaatcctgagagggaatcacaatgtcctggagaagaaaaaggacaataaataatgaggagaaattcagtttgttggggatgggctctgaactggcaatcatgcttagcggcgaggcattgaattctctctgctggtgcctcccgcatctgcggctcccggaggtgtggtctgtgtgggtgat

SEQ ID NO: 94530 - DNA, 541 bp, Homo sapiens
ttcctctctcacggaatagaagggtgacagttatgaacaatgttctaataaacatccacttggtcttacatcttctatccacatgtcagtgccattccctgtgtgaggaaagactgaagtcaggaaacaagatggaagctccatagcaatgggcatgtctggagatgacgttgaccttgcctctaggaggggagcagtgaacatggcaacattggtgccaatggggagtgaaaaggagatggaagaagaggtcaatcctccatgtgggcagtattgggcatagcagaatatgcagagaatgtagggtcacactggtgaacaaaggcccccgagttgggagaaatctaatcttcgctcaatactctcgtggttcaagatcctcacaagtcattggatgtttctgaagctccattgatctctttatttgggtatatttatctgtgtatctagtcagtgatactgttgaactgtaatgatttgatatccatttggcatgtttttgagcatcagttatcatggaccagtagaggggatgcaacac

SEQ ID NO: 94531 - DNA, 442 bp, Homo sapiens
gcacccagctgctgaaaatgtcttaaaaggagaagacacctattttacttaaatgtgacacaacatttaatcactggaacttaatggtatgcattagaactgtttcttgaggaacacagtctctgacttaatgaattttctagcaagtctcaacctttctcttttgggtgtaccagaattctctcgtcagttttccattagttggatttacctgttgggtttaattctttcattttgtatataggtacctctgcttggtttcattttgctttcctaagcaagggagtagaaacagatgttaagactgaaattctactatatttaggaagaataaataaatatatcttccactatggtataatggaaagatatactgacctgggcatactcatgggcaacgtacctgttgtaaatcccctcctttgcaaattgtacctacttt

SEQ ID NO: 94532 - DNA, 923 bp, Homo sapiens
agcggttaaaaattactatctccagatattgtgagaattaaataaaaacagcatactcaaagaaaaaaaaagagcaagggccaactttctcacccatattactctctgttttataaactcagaggatgccttgagaagatctaaaaggagagaaaacactagctattcctacaggataactagggagacagatacagttttataaataggctatgatatccaagagtatatgtatgcagaagtatatttgacagtggatgtgtacaagttctttaagtaagccctaggaagtccagtaagtgaatgagtacagtgttgtagaacaagctatagggaagcattgtttcacctacattagtaatcttatcaaaatatccatcaattttaatttcactccagttagagaaactaaaagctctggtcttagctgcatctcttgtatttcatctgtagtgagaagaaagaacactcttcattggcaattatcaaattatttgtttgaatagcatttttccacattcagctccccatcttcttgcataaggatgatattccctaagaatagaatttagtgataaatgcttctaaggaagccacagagcccctggagctcattaatcctgcaaccttctgtgagcttgctggcctgaaatggttggagttcactttaaactggactgaatttcaaagcaaagggctctgaggtggcaaacagctcattaattcagagtataatacagtgacagaagaattgttttaaatgcacaatctaaaactatttaaattcacattataattataagcaaaaagtatgcactcaaaattgaaatctggatatgtaatctattgataaaactaatgaacaatttttttttaaaaggggggactgtcatcttaccaagaaatgctaatcattctacttt

SEQ ID NO: 94533 - DNA, 1814 bp, Homo sapiens
taataacatctcatcaatttaaaggacaagttcactgatcgtactgtcatactccagagatacatgtgccaagaagcaaagagatgcactcttgtattccagaaagaagatgatttgtaagtgttcagtatttgtgtggcagcccttttaggtgtaatgaagtgtaacagaaaagtaagtgaactacttcacatagctcttaatgtttgtctttcagaggacatacgagtcaggcagcaaaagttggagccattgtatgattgtgtgtcaaaatgagagtcacacacttcaagaactgtaggaactaattttagaaaaagactcttcagaacagatgacacatgaaatgtgagtttatgtaaacatgtaaatttgagtagcattagtttgttttctgtttaggaactgtatcagggtgacaaagatgaaagaatgctgccagaaaagtatattgttaaattttcaggcctccattggtgaagtttcaagtaacctttcacttaagttacttgtgtcagaggatggatgatggggtcatttaaattgttggacaaagccatgaaaggacttttaaaattttgtcataaaaatagccaatgatgtttttaattttacatctaaaactaatttgcattatcctgtgttagtgactgaatctcaactcagtcctcattttttagttcaacttttgacaaccttatattcattgacaccatggacagcacagtaaaaaaatacacaaatttcttttgcagttattgatttggaatgatcactttaaaagagccatcaaatacgcctacatattgagccactctttatcattaaggtgaaaagttcattcaattaaggtatttgagtgctactatgcgccagcctttctttgtgataatgttaattttttttttcctcccctccatgaagggaagaaaaaaaaattaattcggccatgaattttaatattctggccagcaccttatccatttgtagccacgccaacaaatttattctgtgatataccaaacttacaaagtcactctgcgatttcagtaaggcccattcccaacatgagtgctgctgtccacggtactgaaccatcaatgctaaatggtatttagttgtggatcttcatcctgtcatgcagctaaatattccaggaatactgaaccaagtgaggagaaagatagcagtgggttgctgcaaaggaggtgaggggaggggagagatagcaagtgagaaaaagagagactagtggtgatgtttttaagtaattgaagtaaaaaagagagagaaagagagagagaagaggttctactcagtccaccaaagctttttaatttccttacataattaacatgatgaatttttaaataattgttatatttagttttgttcttccaccttttggctatttctactacatatttacttatcataaaaaatacttcctagaccttcctcttatagctattgcctatctctgcctttgcagctgttctcctttaaagagtagtctccattagttttcttgacttcttcatctccctgcataaagatgaagggtatttagctctgaaaatcctttactgttgaatatttagattgttttcaatttttacataatgaacaatgcatcatgggattattggctgcaaataaattggaaacataaaaggtgttttaagtttaaatttttttaaaaaaacaggtaaaaataaaatatttgccaaagactaagggttgcaaagctacctcatgatacactcttataccaatactaaaataaacttcacaacaacaaaattagtgattgg

SEQ ID NO: 94534 - DNA, 283 bp, Homo sapiens
cagactttatgtgattcttggcagtttaggaagtcacttctccctccaatgcaccatctgtggatagatggtgcttcccactggcttgcttctccctggctgtctgctgatgtctccctttagtcacgagggaggaatggatgccatgattgttggtaaatgcttcactaatgaagctaccccatagctggaagccagggccctcagacagaaggttccacagaaaatccaacagtaggagtaagtggtgtacaccatttgaataaaggcacatatcttaaag

SEQ ID NO: 94535 - DNA, 821 bp, Homo sapiens
ggccctgagtgggactcggcccagaagccgagggacgctctaggctgccgggcgctgattgtcagcgcggaggctgggctgaggcgccgcggtaccatgaggcgccggtacttaagagattatggcatcggaaactcacaatgttaaaaaacggaacttttgtaataagattgaggatcatttcattgatcttcctagaaaaaaagatctctaatttcactgataagaacatgaaggaggttaagaagtctccaaaacagttggctgcttacataaatagaacagttggacaaactgtgaaaagcccagataaacttcgtaaagtgatctatcgcagaaagaaagttcatcatccctttccaaatctttgttacagaaaaaaacagccccctggaaggtgggggctgtgacatggcaaataaagaaaatgaactggcttgtgcaggccaccagactgaaaaattacaccatgacagtcgaacatatttggttaactccagtgattctggttcttcacagacagaaagcccatcatcaaaatatagtgggtttttttctgaggtttctcaggaccatgaaacaatggtccaagttttgttcagcaggaatatgagattgaatgtagctttaagtttctggagaaggagaagtataagtgaacttgtagcttatttgttgaggatagaagatcttggcgttgtggtagattgccttcctgtgctcaccaattgtttacaggaagaaaaacaatatatctcacttggctgctgtgtagacttgttgcttctagtaaagtcactacttaaaagcaaatttgaaga

SEQ ID NO: 94536 - DNA, 481 bp, Homo sapiens
catgattgacatcatctagtcaaattatatattatactgagctttattttctgtataaaccatattttacagatattattttaaaagaaattgaaatcttctgggcttaggtttcagagttatatataactcataagtgagctgtgtgagctgagttccttaaacctaggtctcatttcaaaggctagctttgggctggttgcagtggctcacgcctgtaatcccagcactttgggaggctgaggcaggtggatcacaaggtcaggagatcaagactatcctggctaacacggtgaaaccctgtctctactaaaaatacaaaaaattagccaggcatggtggcgcacacctgtagtcccagctactcgggaggctgagacaggagaattgcttgaacctgggaggtggaggttgcggtgagccgagatggcgccactgcactccagcctgggcgacagagcgagactccactccatctcaa

SEQ ID NO: 94537 - DNA, 385 bp, Homo sapiens
acagagtcagtctacccaagaaccaagaggaagaaggcccaggcagatgcacagggacagtgggaagtgcagcctgcacaggacacaactttcccggtgagggagccatgcctaagactaacttgcagctcaggaagttgcttatttaaaaagaaaagaacatttccgagcaaacatctcactgcaaaccaagtttgctgtagttgctgtttaatggtcagcacattcacctctttcatgaaaaccctggttcaaaacagggcggcgagccaggcgtggtagctcacacttgtaatcccagcactttgggaggccaaggcaggtggatcacctgaggtcaggagttcgacaccagcctggccaacatggtgaaaccccgcctcta

SEQ ID NO: 94538 - DNA, 519 bp, Homo sapiens
gtaaaaagagggcataactgggatgtcactaactgctactgttaaaatgagcatgtattaaaatccttatggatgtccccttcatattcaacattaattagaaacctgccctatctcagtgttcttctataatcaatccccctttccagtattactaaggtaactgtaagccctgcatgcctgaactgtcctggtttacacctgtttttccagcataattgttaattgcaaccctgttcactgtctgatgaatcttggtttggacgataaattatatggtcaacctaagtattagagtccctgggataaacaatcaaggtgtcattcttatttattggtattggtttgtcacaagctgtgaaaacagtttttcttttgcttgtttcttcctgagttgtcacgaagaccttcacataaaatcactctctcccattaaagtaattattgaagcccccttcagtaatgaccagttgttttagttttcctcctcagattccaaagaccaaatgtagagattat

SEQ ID NO: 94539 - DNA, 734 bp, Homo sapiens
tatttgtttgtctcctcagcccagtggcactagtgctttttgtttgaatctatcttgtctaatcatctatgttaaaaattgcaaatttccctcaggtaaaattccaagagtctatcaaaactggccagagaagttaacaaagtaccaggtagaatttccaaaaaacaaaaacatagtaattgaaaattaaaactcaggaactggactaaactaagtattaaaaacacatgaaaaagtaagtgaaagatagatctggaaacatttcctgagtgcagcattgaaagtcgaagggatgagaataatgaaaaggatgtaaaatacatagaagaaagactgggaatttcaacacgtgtctaatcagagttctagtaggaaaaaaaaatgccggagaggcagtatttgaagaaataaccactaaaaatcgctataattgattaaaaggtaccgtgaccaagtgggatttatacaaactatgcaaggctgattcagtatttgaaaatcaattactgttatatccatcaaatcaacaggctaaaaaagaaaaattatatagtcctatcaatagatgcagaaaaaacatctgacaaaatccaatacctattcatgataaaaactctcagcaaactaggatagaagggaacttctcaacttgataaagaacatctacaaataccatagctgacatcatacttaatgatggtaaagtagatgcttttcactaaaattaggaatga

SEQ ID NO: 94540 - DNA, 451 bp, Homo sapiens
ggcaaagaaagtagattgatacctctcgtggactgattgtggatttcagcatttgggtagaacagattaatgataagatatggcagaagtgaagaaggtgaatgagctaatggcggataaagggacaaaactgccattttggctttttcagcttgcatttcagcacaaattgagagacttgaaagtcatatagttgcagtgctgaggcaggaatgctcagaagcaatccactttaaatcagtaaagacctaaggactaggcattcagaaaacttgtgacttacctacgaaactttgctaggtaaggatggagtgaagactagaatttaaatttccaccactctgccctagcatctttctgcctctcataaggtttgcctgggaaggtggatagcagcagggtgtagcggttgatattttcattttaacagacacacagaagtgggtcaggt

SEQ ID NO: 94541 - DNA, 436 bp, Homo sapiens
ctgtcttgcaaacacgtgttgactgggttgtttcagttatctgacaattggccatggtatattggaaatagtactggactgaaaaccaagaaacctgggtctgaagtctttgtgacctcatccattccctctgcctttggcctcagttttctgatgtgtaagccaaagatgttctaggctttctcaaccaaggttcttcttctaaattttaagacatggaaaatgatttgtgtaactatttcctcatttctcccaaagatggtatataataagtactattttagtttcataggagacaagttaattcattatatacaatggatgccttggagaaacactgtccaataggatttgctgcaataacggaaatattctatatcagtactaacattatagccattagccaactggggcttgaaatgtgactggtgtgact

SEQ ID NO: 94542 - DNA, 718 bp, Homo sapiens
agcggagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagttttccccccacgacctgacggtgtcgctatagtgacgggagggacagatggcattggctattctacagcgaagcatctggcgagacttggcatgcatgttatcatagagacgtgagtcttgctgtgttgcccgggctggctttgcctctggaactcaagcgatcctcccacctcagcctctcgaggagctgggactacaggcgtgcaccatcatttcctcctaaaatttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcatgctgaccaaccttctcttggatacgctgaaagagtctgggtcccctggccacagtgcgagggtggtcaccgtctcctctggcacccattacgtcgctgagctgaacatggatgaccttcagagcagtgcctgctactcaccc

SEQ ID NO: 94543 - DNA, 266 bp, Homo sapiens
gcaaattcaaggccagtgaccaggttcacaaaatgcaattgttctcaatgacacttaacaaagagccagggagagaatcgattgtcattaaaagctggccaagaacatcgatcgtctccccagtgatgatctcagaattttgacttagccaggccaagagcgttggtgcagagacgttttgatgtgatttctcatgtggaaatgggctccagcatggcgagtcagcacaaaacaagcatgaagctaaggacggagcagccagagct

SEQ ID NO: 94544 - DNA, 839 bp, Homo sapiens
agaacatctgtcacattgttagtctttttcctcctcaagatactttcgtatgttgtccaaccatgatgcttccagacccatgtaaatgagaggattccaagaatgctttcctagcttaagacctctctgggtagccacctctgtcatactttctgagacctgccgccctcatttctgcctgaatcctgctttcctcaccctgtggtcctgtcctggtcagtaaggattgtgtactcagaagggctttgtctttctggaaggaaggtttgctgggtttttgcacagtcccaaggggcttaggcagacctgggttttctggccttacagtcttgcacttaaccctgtgaatctcctcccagtctccttggttaggttcagacccccttgcttagtttttcacccccaggggagaagcttcccttctgcggcgagtactccttattgtctcttatggcctgctcccgtctgacttagctaaatatatgttaccagtctagagtaaattatttctatttagaaaatatataattttagttttagctgttacaacctacaataaattgtttctttaaaacttatttgtgttatatgtcagatattaatcacttttattcatggtgtacgaaatgagagctttatacccataaaactgtgggaagggaattcctttcaggtctttttgttcttggcgtatatcagcatctgttatcttggttttgaccttcagcttgcatccaagaagccagggttttaaggtgaaatgaagattttttcctgatatcaagagccaggtgtattatttataaacattctgtgtggatttttcaattgctaataat

SEQ ID NO: 94545 - DNA, 425 bp, Homo sapiens
gtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggct

SEQ ID NO: 94546 - DNA, 404 bp, Homo sapiens
gcagaaactacttatgtgcagaagatacccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggct

SEQ ID NO: 94547 - DNA, 2112 bp, Homo sapiens
gaggagggggagggaaggagcccctgggagcctggggtagaagtgtaggaggtgggaggattccggcccgcatggagctgtcctggcctcagaaggttatccgtctctcctgccaaccatggagacatatttagacaggaccaggtggggactgaggggtgccaatttcagggggcagctccggttccctccccgccccctgctcctattcctccacctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggagttagcagcccaagtcctagaagacaagggtgttggcttcgggctggtagactctgagaaggatgcagctgtggccaagaaactaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgtggaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatgaa

SEQ ID NO: 94548 - DNA, 601 bp, Homo sapiens
gaggagggggagggaaggagcccctgggagcctggggtagaagtgtaggaggtgggaggattccggcccgcatggagctgtcctggcctcagaaggttatccgtctctcctgccaaccatggagacatatttagacaggaccaggtggggactgaggggtgccaatttcagggggcagctccggttccctccccgccccctgctcctattcctccacctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactaccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatgaa

SEQ ID NO: 94549 - DNA, 1826 bp, Homo sapiens
gaggagggggagggaaggagcccctgggagcctggggtagaagtgtaggaggtgggaggattccggcccgcatggagctgtcctggcctcagaaggttatccgtctctcctgccaaccatggagacatatttagacaggaccaggtggggactgaggggtgccaatttcagggggcagctccggttccctccccgccccctgctcctattcctccacctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggagttagcagcccaagtcctagaagacaagggtgttggcttcgggctggtagactctgagaaggatgcagctgtggccaagaaactaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgtggaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctctccataatgtgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagtagctgccatcttgccatgaccccgcatgcatcccgtggtgtctcggatctaa

SEQ ID NO: 94550 - DNA, 2150 bp, Homo sapiens
gaggagggggagggaaggagcccctgggagcctggggtagaagtgtaggaggtgggaggattccggcccgcatggagctgtcctggcctcagaaggttatccgtctctcctgccaaccatggagacatatttagacaggaccaggtggggactgaggggtgccaatttcagggggcagctccggttccctccccgccccctgctcctattcctccacctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggagttagcagcccaagtcctagaagacaagggtgttggcttcgggctggtagactctgagaaggatgcagctgtggccaagaaactaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgtggaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatgaaaaaaaaaagtcgacgcggccgcgaatttagtagtagta

SEQ ID NO: 94551 - DNA, 1219 bp, Homo sapiens
ggccttccaaagtgctgggattacagatgtgaccactgcaccctgcccagatttaactttttaaaagcctttatttgaaataaagtcactgtggttagaggcctctgacggttttgcattttaagtctgaggactatgttgagtgactttttgcataagttgtaaaatgtgcattcatgttgatttcatttcctatggtttccaattaattgtcccttctgcatttttagaaactcacgggctaatgggctctgtgtcagtttgcatttctagaatgatggcgccgaacactccatgctgtcttttagttggtgcagcaggaggggtagcagagggcgctcagcttccgacagtgccttgagctctagggcgctgcagtgcccccggccgccagcagagcacgcgcgagcccggcttttctgagccttgaggcggccgcatcccgcacgcttcctccgcgcctgcaccctgcaagggcgggagccgcgttctcctcagcacataccaggaaacgcccctcgctttgggacaccttgagccggcggcgtccatggttgagtaaaatccttcctgttttcagccctgactgctgaggggtagagacccttcatgtggaaaattagaaaccaaaatcccctgtgaatccagcgcactcgaggttcattctccacacccaaggcgaggcggccacagggccaagctgcggtcttggaacagaaatgtagtgtcaggaaagcaactagaacacccgccacactgacaataacctctgtagtgctaataacactgcatctgtgatgctagtgttagcacccgtcgtatgcagagagcacacccgtcggggtagctgccttccacatccaaccccgggaacgtggatgtgtccctcagtgcgcacataacgcttggaacgcggagatgacatcgtcacctaacgctacagccgtcacactcatataacccccggaacacgcatgtgtccctcagagcacacacgtaacccctggaacgcccgtgacacagtcagactcacgccacacccgtcacactcatataacccccggaacacgcatgtatctctcagagcgtacataccgcccgggatgcagacatggcctttgcagcccacacgagagggtctgcagctctgaggatggaaccttccggctctcgctggggcgctgagttgacagcctctgctgggctgggtttgggctgc

SEQ ID NO: 94552 - DNA, 109 bp, Homo sapiens
taaatattagggtataatttctttgtatactgtaataaagacaaagtattagaaagtgcaaggtattctacatatcttcaaggtgaaaattgaactatatcattaattt

SEQ ID NO: 94553 - DNA, 276 bp, Homo sapiens
actgtcatatccttttagcaaaatgagattgcctaggttcttgttgcaaaataccacataatgaaatccttcctgttgcatgattaactgggtgagaatatcatctttccttttggtccgtagaaatgtattattcactactccattcttgaggtttgttttttaatttttttggagacagtctcactctgttgcccagtctggagtgcagtggtgcggtctcagacgtctcactgcaacctctgtctcccaggctcaagtgattctcgtgcctca

SEQ ID NO: 94554 - DNA, 297 bp, Homo sapiens
aaacaaaaaggaatacacactgaccagaccggaccaacctccttctctgcggaattatccaggtgcccagaggcccagatcacagacctgttcaggaaaggcacctcttcttgtgcaatcatttgataatttttccaaatgaataaatttattttttaaagatttcccaaagtagtcaatgtcttcaagctctttgccagtggtgactggtgaatgagcagtgcccatgtttataggtgaactctcaggcacacggaggcttgtgttcacaaggagaagcggctgggtccggagcac

SEQ ID NO: 94555 - DNA, 248 bp, Homo sapiens
gcactcatcacaatgaggtcacgtacgcaagcagtaaacaagaaggattctgactttatgaccatcgacttgaacttttatgtataagaaaaataaactttccagctcatttaagccagtggtttttttcggggagtcttctctgtccttgcagctggacctaatcctaactgatacattgatccaactaaaaaggggaaatgcaataaagaaaggaataggagtaagaggcaaaggtggaaattcac

SEQ ID NO: 94556 - DNA, 305 bp, Homo sapiens
gtctttaacattttttagaattccatttgatatatttgtagtgttttttaaatatatttctttgtatttttgtattaatttttttagtggttgctttaagtagtataatgtacatatgtaacataattacagttaatggtatgaaaaatttagcactttgatgtatagaaaccttacttggtcccttcaccttgcctgttaatataattgtctaaagtaattcctcttcaaaattgagcaccatgttggaaaatgtaatttttgcttccactgtcaaatatattttgcaaaaaacacaggaagta

SEQ ID NO: 94557 - DNA, 268 bp, Homo sapiens
ctgagcatgtcctccccacggggtctgagcaaatcctccccacggggtctgagcaaatcctccccatggggtctgagcaaatccttcctatgccgtctgagcaagtcctccccatgggttctgagcatgtcctccccacagggtctgagcaagtcctccccacggggtctgagcaagtcctccccacggggtctgagcatgtcctccccacggggtctgagcaagtcctccccacggggtctgatcatgtcctccccacggggtctga

SEQ ID NO: 94558 - DNA, 453 bp, Homo sapiens
tgctgagaggaactgtcgtcctgctagggaagggagtgtggcacaagggcaggtgggtgtgggcagacccccccacgagtataaagggcagaggatgagaagcccccaagcagcgggagcaagagcagcagagcaactctgcccctggaagggtctggagccttccctcatcactcttcctcaagtcggtgctggacacccaccatgagccaggcagtgtgaggtgctggggtaaaccagagacaagacagatagggtccctgccccatggagctcccagccttgcaagagagctggaccacagacaagtacacaaagaaatacagaaactacagggctatgaaggagaagcacggcagtgaggagtgggaggaacagagaaggcttctctgaagaatgagcagaagtaaccagagaagacagagccctccctgcaatgggacagcctgaggc

SEQ ID NO: 94559 - DNA, 409 bp, Homo sapiens
gggggtgttgttgtcagctccgccatgtcgtggacctgcccccttttcaggacacctcacgtcaccttccataacagaacaggtaacgtgacatatgaggtgcactgttgacaagtgacactggtgacaagtgaggagcactgttatcaatctggaaaggaaatataagcatagctttactcatttatttatttatttttttaatttatttttgagacagagtcttgctctgtcacccaggctggtctcgaactgctgatctcaggtgatccacccgccttggcctccccaagtgctaggattacaggtgtgagccactgtgcccagccagtatcatccaatttgacttctactttattctgtgaccttttcctacagagctagctatgcagactggccatgtcttcac

SEQ ID NO: 94560 - DNA, 656 bp, Homo sapiens
gctttcaagctaaaaaatttaaaaacccttatttttattgatctgaaagttgaaaaaccatgagcattttaaagttacgttagaaagtgagttttataagcttcttcttaaactcaatttataatctacaattattgcataaagtgattttaaatctttaaaaatcttgaattggctggcactttgggaggccaaggtgatccacctgcctcagcctcccaaagtgctgggattacaggcaggagccatcgcgcccagcctgtattttttttaagacctactatatgtctggaactgttataggtttggagaaccagctaatagtaaacaaactaatataaaaatgatgtaatcaagtaatttagaagattttatatattattgttgccaaaaaggtgatcaagtagattttctttgtcaaagaacataacagttttttcatcagtgcatgataattgagtacttttggaatcacaacactttaaacatttagacaggatcctatttacattttagaaagagattaagagatattctatagatgtgtcagtatgatggaaagaatgcattgtttttagaaagtcaatgagcactttaaaaactttcaactctgttttaaaccttaagtataaaagaaactagctacaaatacccat

SEQ ID NO: 94561 - DNA, 444 bp, Homo sapiens
tttttaaatagacaccaagtctcaccatgttgcccaggctggtctctaactcctgagctcaagtgatcctcccacctcagcgtcctaaagtgctaggattacaggcatgagccaccaggcccagcctgaaccaccatttttaagccccactcagctgaagacaaatacatcaaagcaaacttgtccttagaaggggagaaggggctgctggctcatgcttgtaatcccagcactttgggaggccaaggtgggtgaaatacttgagcccaggcaacatggcgaaaccttgtctctataaaaaatacaaaaattagctggctatggtggcataagcctgtggtcccagctactcaagaggatgaagtgagaggattgcttgagcctggaggttgaggctgcagtgagccgtgattgtgccactgcactccagcctaggcaacagag

SEQ ID NO: 94562 - DNA, 269 bp, Homo sapiens
ctagttttttttttctttccctctcagtttcattcttttcacgaaacacttatttcaagaacgttgtctgctctgtgcctggtgctgggaccgtgaaggtcccgtgccgggactaggcagggagcctggcggctggcgggggtgggcacccgtgtttgcagaggtggggtggggacagcggggaccagcactgggtggagttccacagctaaatcagccctgggattggaaacaagcgaagactattctcactgtgcttttccttacat

SEQ ID NO: 94563 - DNA, 2069 bp, Homo sapiens
tagtcacatatttacataagatatcatagtcatggtagactaatgagaggagaagcattttggttatgtcatttcgggataattttatcagttgtgagagtttaacaataaagaacataaaacttgctgtttcataaaaatatgaaattttcctggagaaattttgacttaataaaggaacaaagaactcagtttgtagtgaataaaattttacattcacttccccactttctcatagaagatctacagttggggataaccgataagaggcaattggtttctggcttaagagcctttctcattaggaattttcggtaaattaaagtctgaaattagaaaaacattagacattaatcaacagaccaacaccagtcacgtaaataaatggcattcgtataatttggcagctgaaattcttaaataatctggcaggtacaaggagagaaagaggaaaaatgaaccgttcatcattctcactgcggtctcaccgtttctctccccacctcctttttaaaaattccttttttgcctctgtttccaaagaaatgccagctcaaaaccaaggcagttggaatttaacagctctaggaagctctagtgagaataaaagccaaataatatgaaccagccaaaattccttttgcaacatttttccccaaaagaaaaatacagaagatatttcttttcaagtctctaattctacctttaaaaaatatgtgtactaatgaacagtattcattttaaatctagaacctgggaatatattactataggcaagacacctttaggtaaagagctcataattttccattgaatacagtaaaattataaagaatgtaacaaaggctttggtaatttggtagaggggctttttgatgaaaaaaagacagatgatttagaaagcgaggaacacatcaagcctcagggaaagaaaatgtttgattggtattaattaaaacactgctaatatattctaataaaatcaaatttaacattctaaagtaatcctcttggtatgtcaaaggaaaagaaaagtattatcttatttgcatctctgcaatccaaatgcatttgctcattcagcagaattaatttttatcaccagcctgttttatctcctcacagatttagtcaaagttattctttcaaactagaaaggatcagggtggggaatccatggaaggtattggaagactagtgactgtatttagtaccggctttatattttacgatgttctttctcttcattcgctgtaatggggtgtggagggaaacggtgagaccgcagtgagaatgatgaacggttcatttttcctctttctctccttgtacctgccagattatttaagaatttcagctgccaaattatacgaatgccatttatttacgtgactggtgttggtctgttgattaatgtctaatgtttttctaatttcagactttaatttaccgaaaattcctaatgaaaaaggctcttaagccagaaaccaattgcctcttatcggttatccccaactgtagatcttctatgagaaagtggggaagtgaatgtaaaattttattcactacaaactgagttctttgttcctttattaagtcaaaatttctccaggaaaatttcatatttttatgaaacagcaagttttatgttctttattgttaaactctcacaactgataaaattatcccgaaatgacataaccaaaatgcttctcctctcattagtctaccatgactatgatatcttatgtaaatatgtgactaacaaaaaaaaaatgaatgggccataaatactgaggaccatatttgcgtgtttccaaagtgaggggttctgcgtcctatcaaggagatgtaaactactgactacactaccgatgatgctggctttttgctccattgccttttcaagtcttcaacgtaaaagagcaatcgcagttcggtttcacatgtattgttctataatccaggcaataaatgctaattagtaatgctcaaggatccgaccattcagagtaattatcataatttacttcttccttgttaaagacattccttgctgattagaaaaa

SEQ ID NO: 94564 - DNA, 1786 bp, Homo sapiens
aaaaaaaaaataaggcggggaactggggcgggggtgcgttgcgggaagaaaagagaaagaagtgaactggagctttcggacacagaaggacaggaagcttgagagaaaaggagaggataatgagtgaaatgcaatgcagcacctccttggaacacacagttacaattcagttcacagggcacactggctcaccgtatttttaactagtttctctccccacctcctttttaaaaattccttttttgcctctgtttccaaagaaatgccagctcaaaaccaaggcagttggaatttaacagctctaggaagctctagtgagaataaaagccaaataatatgaaccagccaaaattccttttgcaacatttttccccaaaagaaaaatacagaagatatttcttttcaagtctctaattctacctttaaaaaatatgtgtactaatgaacagtattcattttaaatctagaacctgggaatatattactataggcaagacacctttaggtaaagagctcataattttccattgaatacagtaaaattataaagaatgtaacaaaggctttggtaatttggtagaggggctttttgatgaaaaaaagacagatgatttagaaagcgaggaacacatcaagcctcagggaaagaaaatgtttgattggtattaattaaaacactgctaatatattctaataaaatcaaatttaacattctaaagtaatcctcttggtatgtcaaaggaaaagaaaagtattatcttatttgcatctctgcaatccaaatgcatttgctcattcagcagaattaatttttatcaccagcctgttttatctcctcacagatttagtcaaagttattctttcaaactagaaaggatcagggtggggaatccatggaaggtattggaagactagtgactgtatttagtaccggctttatattttacgatgttctttctcttcattcgctgtaatggggtgtggagggaaacggtgagaccgcagtgagaatgatgaacggttcatttttcctctttctctccttgtacctgccagattatttaagaatttcagctgccaaattatacgaatgccatttatttacgtgactggtgttggtctgttgattaatgtctaatgtttttctaatttcagactttaatttaccgaaaattcctaatgaaaaaggctcttaagccagaaaccaattgcctcttatcggttatccccaactgtagatcttctatgagaaagtggggaagtgaatgtaaaattttattcactacaaactgagttctttgttcctttattaagtcaaaatttctccaggaaaatttcatatttttatgaaacagcaagttttatgttctttattgttaaactctcacaactgataaaattatcccgaaatgacataaccaaaatgcttctcctctcattagtctaccatgactatgatatcttatgtaaatatgtgactaacaaaaaaaaaatgaatgggccataaatactgaggaccatatttgcgtgtttccaaagtgaggggttctgcgtcctatcaaggagatgtaaactactgactacactaccgatgatgctggctttttgctccattgccttttcaagtcttcaacgtaaaagagcaatcgcagttcggtttcacatgtattgttctataatccaggcaataaatgctaattagtaatgctcaaggatccgaccattcagagtaattatcataatttacttcttccttgttaaagacattccttgctgattagaaaaa

SEQ ID NO: 94565 - DNA, 518 bp, Homo sapiens
ggaccaaggaagaatgtttttgagggaaatagaaattaccatcctaaaaatggttccttctgtgtgtctgctgatagaaacccttgacctctttagaaacaaccgcaaaattattcactacgattatctgaatctcataaataaaataatgattacagcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacacataactctgggcgtaaagtgagtaaaaatatgagacttagaagaatatttcatcatggtatgctgattggggatttcacttactgatactagaaaggttttgcatttcagaacacgatgaaataggtaatatttatctgaaagacgcagacaagtggtggaggaaccagacacccccagtgccgtttgctggcttttatcagacagaa

SEQ ID NO: 94566 - DNA, 684 bp, Homo sapiens
tcattcattcattcattccttacatctgctgagagctcatttaaaaagcaggtgctatagcaggcagtggggaggaacccctggataaaaggaatttctgtccttagggttcagtctaccaggatggacagacacaacaggggagcggcaggtgggggcaaggctgtaggtgggcttggggctggccccgtgaatgtctgaccaccgctgtcaccgccatagcagcagggcagcttctccggaacttgtataaatgaagcgtgtcctccttgccccagacctgcttgatcaaagtctgtatttcagcaagatcccccaagtcttgcacacactagggaagttagggatgaccatgacctgtagctcgtgaggcctcggtacaagaaatcctcctccaggctggcttggggagacaggcagggcccagcaatgccttctccagccacagaaccatttcccactagaacctttcctcctcacctctttcaggcctagcagggtgggctgctggctgtgtgcaagggtgggatgagggctctgctagagccaacaccagccctgccagctcacttgtcccttgtgcaaacactcatcttgggctcaccaggccctacctgacatgaaccaagctgttaacatcccccgccctcctggggcctggcccacagacatggcccagcatgg

SEQ ID NO: 94567 - DNA, 613 bp, Homo sapiens
agtcctgcagtcaccccgacactgctctccctctcacctcacacatccagcccagcagcaaatctagccagctccaccttgacctggaatctgcttcccaccccctcctctgacatcaccctggtccccatccccatcactgcccacctgggttactgcagcagcttcctcccggcctcctgcttccatcccaccccctcagtctagtctcaaccttaaagtcacagtgattgttaagacctaagtcagatattgttccttctctgctcaacagtctcttgtaactcccatctcactcacaggaaaggccaggagagtctgcactatgactcacagggtcctgctccatctgcccgcttccctctctgccttcacctcttacctctcttcccattgcccacgtggctccagccacaccggcctccctgctgttccttgagcattccaggcaccgtcctgcctcaggactttgcacaagctgctggttctgcctgaagggctcttcctccagatacgtatgtgcctcactactttgttatctcctccaaatctttgctcaaatgttatattctttttttttttttttgacatggagtctcaccctgttgcctag

SEQ ID NO: 94568 - DNA, 292 bp, Homo sapiens
tgctgtagatggggctttctcttcttgtatattctctaactggttgattttatttctatatgttaattttatatgctgctacctatctgaattattgtttgagttagttttattattgcttctctagggttttccaggtgtactaacctaccatatggaaataaagatagttttacatcttccttgccaattcttaaggcttcattgattattttctgtctagttgcatgggctggtatatctagcacagtgttgaacagcaggggagagagtggctatccttacgttgttc

SEQ ID NO: 94569 - DNA, 440 bp, Homo sapiens
aagacgtggatggaggatgtttaggttggtccagggctcacttcagccctaggagtcagtggggaagatggaggccatagatggggtgatcaacaggtttgtgatgagggacaggccattgttcacaagtgaggccagtattaaaaggaggtgagaatctccttattgatacagccctgattccaaatcagatggcttccctgtgggcagaagagctatgtaactcatcccctggggttgttcagggcaagtcaattcttggccctgctgttccctgactgtatagtcttaagccagtttctaatcttcttgggcctcaatttcctctttaaactacacactcacacatacacacacatcacaagataagacctgtaatggacttggagcagtgaagctcagacatgtagtaagttatcaataaatggcaactatcatcc

SEQ ID NO: 94570 - DNA, 398 bp, Homo sapiens
ctgacttacagtgtgcaaatatcttttatacaaagatgcagccgctttctccctaaaatggaagtatgtgatcctattactggatccatctcagaatgttgttaatttttcttctgattcagtaacaattcctcctggatattctgtaacataaagactaaattgtaaatttagccacttaacatgaaataaaatgatgcggaaagggaggtagatgtgggcaggatggggggggcagatgaatatatgcaaatatgtagatacaagtaagggaaatatgcttgggtgttataatgtaattatagaaatcaataactaaatgtaatgaaactaaatgtataatgtataataactaagtatataatgtaatttagaaatcaacaactaaaatgaaactg

SEQ ID NO: 94571 - DNA, 402 bp, Homo sapiens
ctcaccgaaagaaggaagcatttaagattgagcaggaaataatggccttgtttcagcaaagagatgacaccagtccaatatgtttattattgttggtttatttcataatttcattttgttacattctcaaggaacagtgtgttcccagtagcatctatcaagtgaaccctggaggctggtcacattcataatcttttgtttttctggctacatagaggtgattttgaactacaagatcatctcagctattcagagtttagattttatttagccttatttgttttgcctagcatttatgtatttgaaaatatcttgatttttaatcttctatcaccttggcccttacctgaagtgaactttgtttgaactcaattgatttcacctctcaataaatatgaaatt

SEQ ID NO: 94572 - DNA, 354 bp, Homo sapiens
caatatcttccttctagctacttgaactagataaatattattgttaactgtagtcatcctagagtgctatagaacactagaccctttctatttagctgtaattttatatcctttaacaaatctctccccatccccaagaacctatgtcaatttaactttccaataacaatgtttgaaattagtacagatgtccccatatcctcatatcattgcatactatcattctattttcttctttgtcttctgatagactaaacagacaccttgacatttaagcgtatttgattactagcaaaatggaccgtcacttcataaacttattgacaataggtacatcttcagctctttttacac

SEQ ID NO: 94573 - DNA, 351 bp, Homo sapiens
aactgcagattttttaaaattctttcgaatagctaatatatttacatggttcaaaaatctaagcaatatgtgcacacaactgagaattctcaccatcaccaacttctataaataaccaatctttcttaccaaaaaatagtaacactgttctgcactgttttaaaacttaatgataaaaatttgccataataaattttcagtttggaagaaggttatacaatagcaacatagcaaataaacttattttttaaaaactgtgcagaaaaaaagactgaaagtttataaaccaaaaactgatgaattacgttttaattttcttctttgttgactatttttttttttttgaaactg

SEQ ID NO: 94574 - DNA, 438 bp, Homo sapiens
atcatgttagtaattaaactctctctcctcttgagactcagtgagagccttccccttacaaaaaaacaaaaaagaccatagcttgctgccaaagcggatctgaccacgcgtcctctcactctaagagattaaaataaagcctcctgcagtccttttctccaaatacacaaagaagtggctgggctgaggctcaagggcacagttccagtccctgttggcaagagaagggcagggctctggttctcccaaagggtgcaaaggacaagaatgtttcctagaaaagaaaccagggaaggagaccaaagtagacctagctgatatggagctgttatgtgaaaactgaaagctgcttcgatactacttcaaagccagattattctgggaactgaagggagactgagccttcaagtaatatgactagggaagtcaagtacaaaa

SEQ ID NO: 94575 - DNA, 390 bp, Homo sapiens
cttctaagagttttatagttttaggtcttactggggggtagggggtactttgatccattttgagttggtttttatatatggtgttagataagggtccaacttcattcttttgcatgtggatatccagtttccccaacaccatttgttgaaaagactctgcattccccattgagtgatcttggtaccttgttgaaaatcactggctatatacacgaatgtttatttatggcctattcttttccaatggtcgatgtcagtctttatgccagtaccacactcttttagttactgtagctttgtagcaagttacaagattaggaagtatgagacctccaacttttttattcttttttcaatattgtttcgtctgtacagggtcatttaagattc

SEQ ID NO: 94576 - DNA, 328 bp, Homo sapiens
  misc_feature (23)..(23): n is a, c, g, or t
tttaatgttgatatttagtatanaaataaagtagagatctgtgctttattttaaaacatccagattttaatgtactagtaaattttttttcactttcctgcaaagatctggtaagcaggaagaaatgtacatcctgaaagaagtgagctactgcgcctggcctcaaattgttttttcctgatttttcttaataatgttgtgtctgggcccagcccagtggctcacacctgtaatctcagtgctttgggaggctgaggcaggcagatcacttgagcccaggagtgcgagaccagcctgggcaacatggtgaaaccctctctctacaaaa

SEQ ID NO: 94577 - DNA, 548 bp, Homo sapiens
cttcaacagctcctctgtgacttacctggagtctgtccagccccgagataagacccaagatctgaaccctcaacttcctcccaaaaaagcctctcttccattccccaacatcgcaggggcggagaccaatgcctccactctcttcctttccccaacatcgcgggggccgagaccaatgcctccactctcttcctttccccaacatcgcgggggccgagaccaatgcctccactctcttcctttccccaacatcgcgggggccgagagcaatgcctccactctcttccattccccaacatcgcgggggccgagaccaatgcctccactctcttcctttccccaacatcgcgggggccgagagcaatgcctccactctcttcctttccccaacatcgcgggggccgagaccaatgcctccactctcttcctttccccaacatcgcgggggccgagaccaatgcctccactctcttccattccccaacatcgcaggggccgagaccaatgcctccactctcttcctttccccaacatcgcgggggccgaga

SEQ ID NO: 94578 - DNA, 378 bp, Homo sapiens
ggcaccaggggcccagggtagctgtaagggcctaatggtccctgggactgggttgtggggccaggtgaggctggtctgatggaggagctgttcttggaaggagaattctgtttctggctagacccttgtttgagtacaaggaactgtgaaggatccatttgacaggaagcctaggataaaactaaactcattcttttttcttacagctcacctctgagtcttgagctccaaaccagcccctcctgctgacttttccattatcaatagtctcctatacccagttgtaaatctcagggtaacgctgactttccacatttaatcaattatcagattctgatagtccttcacaaaacagttgccttttgtccccacttcctt

SEQ ID NO: 94579 - DNA, 395 bp, Homo sapiens
ttacctctttgaataacagtagtaagtacagtggtgatcctgttgactgccaggtggggagtttgcttagctttagccctcaactaatttcaccagtccagactgtatgtatgtttatactgctatttttaattataagtgttcacttcttcaaaacagatatttggtaactgtgtttaattaaaagtgtgtgtgtatgtgtgtgtgtgtgtgtgtgtgtgtgtgttttaaacaaaatggaaaacaagcaaaactcatctcattgggttattcaaaggtagagatgaaagacgataaaaatagccataattcatttaaaggaatgttgcagagagaaaacatttattggagatttaccaatgaataaacatatagccaaaataatttgtacacag

SEQ ID NO: 94580 - DNA, 278 bp, Homo sapiens
tataatcatgtaggtataggaaataaagtcatctataatatttctataatatggctataatatggctataaatctataatatggcgtgagccactgcatctggccttcattgttgtaaatatagagttgtgtcctattgggagtacatgttctagaataaaggattttatctcgattcaatttggcaaacacctttggttactatagtttggacttttcttttgaattcccaaatcttatcaatcccatctcttaacagatttcagcttttcatttta

SEQ ID NO: 94581 - DNA, 374 bp, Homo sapiens
tgtacacaaggccccaagagaccagcccagcccagaatggagtcatgtgtgctaggtgccacataatcaaactgatcatggcttttaaaaagccagtttaaacaacaacgaaaacaaaccagattttcagcaaccagtccaaacaggtccagtcaccgtaagctggcatgataaggaaactttctcttccttaaccctgtaaggaaagtaacttttaaacaatgaatccacattttgtttcttgttttatgttcttcagcctttctgtctataaagcctactccctctgctcagctcattcgaatgtctttctgttttgtagatggaatgctgcctgattcacaaaacactaataaaaaagaatttgatctttg

SEQ ID NO: 94582 - DNA, 311 bp, Homo sapiens
ggatcactccctccaggaatccctccggctctgtaggacccagtttgaaaacccagtgttatgtgatgctaaatgctgacattccttccctgcctgtcagctttgctctcggaggtgcctaatggcgccagtgctgacctaatgcggccggtgttctggtttgtttctgaattgcgtgttgaggtagttggggggctttgttactctgggtggctggtctgctttattattagtcttggggaaatgatttctctgagaagcagtagaaggtgtaaattatgcttcactgcaaatcatcaagactatatata

SEQ ID NO: 94583 - DNA, 278 bp, Homo sapiens
cgaaatgattcgtgaacaggatggtttgagccagcatgttttttaaggatcaaactgagggcttgttttctcccccaccccttgatgggcttttaaaggtgcattcaatgctttcacatggaaacctggtctgttgcagatcagagcttgttaccccttcctcgtgactccggtcctccaaccgcatcagggcacccggcccctctgctctggggaacgcaggtcactttgcaagatgcggggaatattcacagggctgcaatgggctatctgtcttc

SEQ ID NO: 94584 - DNA, 144 bp, Homo sapiens
ttttcccaagccttggagggtaagatctttcttctagtctgagggtgaccagtctgctttttttttttgagagggagttttgctcttgtcacccaggttggagtgcaatggcgtgatcttggcttactgcaacctctgcctccc

SEQ ID NO: 94585 - DNA, 429 bp, Homo sapiens
ttctgggattacaggcatgagccatcacgcctggcccagactatttttcacgtacttctcacaccagccttgtaaggcagcgctgtcattatccccattttacagatgaagagaccgaggttcagagaggttaagtaatgcccagtgtcatatagctctgtctgactcccctcttctggcctgcctcccactgaggcctttcagcctgatgggagagtgaactgtgtacccgtattcatgtgggtactgggcactgaactattaaatatgcacagggctcggaaatccactcccaccccacctgctcattttgtctttcccttctgtgttccagtgcctaccgtcatctttagagaaggtaggttaagatgccactgccctgctagacactcggaggggacatggctggggtctaggggacatggctgg

SEQ ID NO: 94586 - DNA, 182 bp, Homo sapiens
catggatgaactgtgtttctagatttttcctccagctttcctgagagtaagttaacctctaaaattgtggttattttgcatatagaaatataacataagactataaataggcatgccagacgtttaggtagaaaccattaaaagcagtaagttattaacgagtcattttgactttttaaatc

SEQ ID NO: 94587 - DNA, 374 bp, Homo sapiens
caaactaaatataaaagaagaatactcttctcttgatcctgaaagtaaaatacagagaaattcaaaagaaaccctaaccattgatttcatttctcagtggaacaatctctatgtgtatccaaaatattgtgatgtactcagaagtcccatggcctaactaatgaaacatgaatcacagatttcaagaagttcagctgtaagattcatatgctctggagaaactcacaaaactgaaaacttgtctttttataaaataatagtactgtgtttcaaacctcacaaggacctcatagctcaacccctcttctttgcagaagaggctcaaggaggtaatttgtctattgaagatgaaaaaagttgttaatggcagaatc

SEQ ID NO: 94588 - DNA, 789 bp, Homo sapiens
agcggagaggacaccattgcctggagatgacagaaggctgaggatggagagaggcactgatagaggccagaccagacaagcagtgccaagtccatagtgggacaccaaagggaggaggcaatcccagatgaggtccatcccagaaccagaccttgcagggacctcaaggagctatgaacatagaaaccctatacacgatatcacttgaatccctccacaagggcttctgatattgtcttagacctttggaaagttcaggggtagtagcctctgggcccatagtgctcccctgatgatgcagccccaccctcaactcttgccactgcagatgctccttgggcagtttcatctgggcctttcacatcagctccctccaaatgtgactggacctcaaatggatcttcagacccccatgcccaaccacctcccagctaccttccctggacaacccacaggtcacatgatcaccaggaagcccatgtctctgcatgataacctggagaaacctacagatgccaggcttctgaatctcattcaccatgcttcccagggatcaaggaagaaatacccagagatacagactgaaaaatcaggaaactggatgggattcagagcccttggaatggagccttctcattcattcacccaactccagtctaaaacgtgcagctctgaagcagggctgcttcatagagacttgagtaaatagcacagtaaagcccaggttttaccagtgaggaggagagtaaatacactgatcatttgcaagagcacctcttcagatatggc

SEQ ID NO: 94589 - DNA, 165 bp, Homo sapiens
actacaggacccctactctttatcctaacctgatatttctaaatggtcttggaaactagaacttgcgtagttttctactgatacgagctttttccttgatcagcaaaatcacaaaacttgtgttaaaaagtataattttcattctcacatgctgaaagagaaaca

SEQ ID NO: 94590 - DNA, 282 bp, Homo sapiens
agtagagctgtggctgctgcactgagacccagccgtgggtggactgagctgcttaagaccctggttcctcttcaacatcactgcacccctcttggtccctcttcccttgggggtgcactgctgaggtctcctaattctgcttccctaagcccttgctgctcccagtgtggtctgggaaccagtggcagctgcactgatggggcgcccatgaaaaatgcagactcccttgcccccagacctgctgagtcagtctgcagttcaccaagctttcaggcaccttct

SEQ ID NO: 94591 - DNA, 339 bp, Homo sapiens
gtgagctccaatccatcatatctgctataatcagcacaagttctttttcctttggtaattgtattcatttttatggattttgaggatataatttcctatcagtttaatgaagaaatatgtcaaaactcatattcatagttttttagatataggaaataatttattttcaaattgtgaactaattaacttgtatgccaagaaagatggtgtttattctctaggaccagagttccctgtaattttcttaagtttggaatggtgggaaatgctcttctttccagtcttcatcctcatcgcctgctagcttactgttaccactttttaatgctttaaggccca

SEQ ID NO: 94592 - DNA, 414 bp, Homo sapiens
ttttaatataatttatatttaaaatatatgctttaatttttaagttcttacagtgaggatgccatatatttaagctgtcaaaacagcttgtatttgtactcttttctagtgttgtgggccataatacatatatactcatgggcagtataacatttgccttcttaattttctttttaaaagttgttgtatttaatttatttttatttttaattttttgagatggagtctcactctgtcactcaggctggaaagcagtggcgtgatctcagcttactgcaacctccgcctcctgggttcaagcgattctcctgcttcagcctcctgagtatctgggattagaggtgcgtgccaccatgcccggcttatttttgtatttttagtagaagtggggtttttaccatgttggccaggctg

SEQ ID NO: 94593 - DNA, 261 bp, Homo sapiens
agagcgcgcggaggttggcggttgggggaggtgaagctgtccaaagagggacggtgtttaggacaggttaagcaggtaccatccaccactttgggctgggcgatctgccaggcatctgcccccacctagcctctgcccccacctggcctctgaccccactgaacaagaagacgtggtcacatccagggtacactggaaaatctccctgctctggctggggcctgcagagcttgaggaagtttagaatgtccaaagtccaaa

SEQ ID NO: 94594 - DNA, 307 bp, Homo sapiens
gtattactgcatcagggataaaggaaaagtcaaaattatctcttattttggtagatgaaattgaaaaagttgcagtgtgtgtgtacatggtgcatccccccaagatctatccataagaatggcttgctttttgcttatttatataaaacccactatgttaaaacaatgattttgtttaataatttacaaatttatcaatgatttatacatcttaattttcagtaatatgcagtatttgttgccaaatggtgtaatacaattatgaatgtctgaagataataaaaccaagatgagtagaaatttaaga

SEQ ID NO: 94595 - DNA, 445 bp, Homo sapiens
tattcgggaactcccaaaccctccctaaatttatcatcaatattaaaaagtcttctttctattatatttatggcacttaaactgaagcttagtttctaaacagtctcaatctattttgtgttatgaaaacaatccacaatccttgaaaacattcagatattgcaggcatatgttaacttaaaggaaaggactctacattcaaaagtcctaccctactactcttccccaaagcagccacagttaacatttttatgttcaattttcaaaatttttgacagtgtacattcatgcacactttatctgcatgggtttttataatttatacacatgataactatagataactttctacttttggattttttagttaacagtatattgtgaagataccctcatgtcaggacactgaattttgcataatgttacaaaatgttgttgtatcaaa

SEQ ID NO: 94596 - DNA, 633 bp, Homo sapiens
caagattgaacttggacaccaaggatgaaaaatgccacacaggcctcctgagaagggcccagggtatgcctagtcagcaggattcagttcagggtaccagatttttacagatattttaataatgactcttaaattattgaaataaatatagacaaccccaaaccttggacactgtatataaaaagaaacctaagaagactctgaaaggtagaaagaagacagacaggccagggaccttgggaactgaagaatgacacactggtgagttcctggggttttcctcttggctcagatatcccagacttggagctaaagaaactggagacccagaaacaccatgaggcctgagcagacaaacggagccccaacaaaagtccactctttctagccagaggaccagggaaggggcagcctagcaagacagaaaactcgagacagtagctactttcctccagccaaacacctctgcaggaactgtagccacacccccacccaccactccagcggaggcccaatgaggggcctagacagtgacaaggtacccagcaccccaacagggtggtgtcaaagggactgtcatcccattggggataatgagctactaagcttttcaatggaggcttttcagtgaaa

SEQ ID NO: 94597 - DNA, 676 bp, Homo sapiens
aaagatagtattttgagcagaatagtcatgaaaaacttaggagatttcagcagagattttgaatgaatgaaaagaagtcatgtaaatctctaagaatgttttaggaaaaggaaattgcaagtaaattttctgttaatggattgtttcctatttttaactttctccatctgtacctttaagagctaacctgtatgaaagtgtcttgcacataaatggccaagtatttctttgtttatgctgttcactaaaatattcttgataaaattctgtccatcttttaattctcagctgttactctttttcatgaattctcaggtcatctttcttgcctatctagtactaggtaacttttctctttttttttcttttctttttaagagataaggtctcagtctgtcacccaggctggagtacattggtgtgatcatagctcactgaacctccaactcctgggctcaaaatccttctacctcatcttccagagtagctaggactacaggtgtataccacccacaccaggccttttttttttttctttagaggggggctagctgtgttgcccaggatgttcttgaacttctggcctcaagcaggcctcccacctcagcctccctagtagctagtcttacctagtgctatataatttttcaatgtcagttatttccttttttataaa

SEQ ID NO: 94598 - DNA, 242 bp, Homo sapiens
tcaataattttgtatgccttcatacagtctttttgggattggcctttttcacttccatggttctctggttgttgagtttatcaatactgtagtttattcctttttgtggttgatacagacttctatactatgatctggatatgccacagttagtttaactgttcacccactgtagaacatctggtttgtttcctgttttcacttttgtgaataaagctgctaataaatattcatgtcgaggg

SEQ ID NO: 94599 - DNA, 338 bp, Homo sapiens
cctaatggctagtgatgttggacattttttcatggatttatttaccatctatacatcctctttggtaaagtatctattgaatgctttatccatttaaaaactggattgttttcttgttaagatttaagaattctttatatattctggataaaagtcctttgttggaaatgtgatttgcatatatattttattccatctgtagcttttattttcacactcttaacaatgtcttttgcagtgcaaaagtttttaattctggtgaaatccaacatgtcagtttcttcctttatggattgtgcttttgttgtcatgactaaaaactctttccttaacccaaa

SEQ ID NO: 94600 - DNA, 725 bp, Homo sapiens
gtattggggctcagaaatcgataccccaaaatgtcgtgctttgacctgctgaaatgaagtctctaggtattttgggcctccacccccgccaccctgcccctcagtcttctgtctctcccaaaacaaaggataaaattgttatctgaagttcctagataaaagtccagaaccctcaaagaagaaattttgaacaattacttttggtctcttggcgtttccattaaatgaactcacttcacaggaagaaagactgtctatcaacatacctgaacaaatttttttgccacagccattatctgctctgtgggtcgaacaactttgttccaggacattgtatgttctttaagccattgaattcccttaaaaatcatttactatccccctaaaattatccacacttcccatgtttctcgccccctagaataaaagtatataaccccattctttggtggggcagtcactctgtgattctcccccatgtacgctaataaatttgtattctatttcttctacgaatctgcctttgattagttgattttcagtgtaccttcagatggtgaaggcggggagttttccattagcccccacactggtttctgttgtaccccaagccaagaaaaccagtgtttcctttgtcctattaacttgtgattcctatgatggcaaaacaatgatctctttttcccttgagtctgttgtccctactcttccctctccagggaata

SEQ ID NO: 94601 - DNA, 582 bp, Homo sapiens
catagctgactcctgaggatccacgaaggtttaattggctcacagttctgcaggctatatggaaaacactgcaccagcatctgctcctggtgaggcctcgggaagcttacaatcatggcagaaggcaaagggggagcaggtgtgtcaaaaggagaggggcaggagagagagagaaggagagagagagaaaaagagagcacaaaagagagaagggagaggccccaggctctcttaaccaaccaaatctcgtgtgaactgagtaagaactcactcatcaccaaggggatggcactaagccagcagtccccaaactttctggcaccagagaccaattttgtgggagacaatttttccatggaccatgggggatggttttgggatgaaactgttccacctcggatcatcatcaggcattggttagattcccataaggagtacttgacccagatgcctcgcatgcacagttcacaatagggggtcacactcctatgagagtctaatgccaccactgatctgacaggaggccaagctcaggcagtaatgtgcacttgcctgccgctcacctcgtcctgtgtggtccag

SEQ ID NO: 94602 - DNA, 474 bp, Homo sapiens
cctgggccacaaagcaagatcactgtctctacaaaagaaattttacttgctgggcgcggtggctcacgcctcggcctcccaaagtggtgggattacaggcgtgagccactgcgccccgccaattttgtatttttagtacagacggggttcctccatgttgtcaggctggtctcaaactcctgacctcaggtgatccacctgtctcagcatcccaggcatgagccaccaagcccagcctcatttggttactttttgcatggaatttattttttcattcttttgttttcaatctctttgtttctttgtatctaaagtgagtctcttatagacagtatatggatggatcatgttgtattttattttacttattttttttacatttcccaaggctctgtcatccaccttttcattaaatcattctaccaatctctcctgggctcaggtgatcctaccacctcaactgcctgagtagct

SEQ ID NO: 94603 - DNA, 952 bp, Homo sapiens
cacattgcctcagagggagggagggaggatcatcaggcaggagacgatccaggagttcagatgctgctgctagatttctctcccctgcctcatcttccatgcctcatcttccccttgtgtgttaccttcactctcatctctgagattagacatccttcacacccagagaattcggccaggcttaccttgtggtagctgagagccctagagaaaaaaaaccttctctctccctgggctgaattagaaagtcccagggaagaactctgattggccaggcctgtttcctgtgccctcccctgtgacttagtagaggtggggcctgatgctgtgattgacagcctggttaatcggctaaactcagtaggcgtgtcccatgcaccacaaggaattggggaggaacaattcccaaaggaaggaggttgctgttagcagaagaaaggcaaaacaacctgtgtccacatcatccctcctgccacctctggccctgtgctttcactgcactctgcacacacccccagcagaccccacccgagcttccagggatgatttgggtacttgggtatgggtgactgtccctgccactggacgatgaagtcttaaagggccaagactctggtcaccttggctctcccagccctctgctctgtccctgatcataaactacttttgacgaacgaagaaaacgaaggatcaaggaatagaaggggttgtgtaaggggccaaccaggatgaaaatcttcatctaggctcttccaaccctaccctgcagcctcctccctcaacccacaatcagcaacatatcctacaaaaacatgttgacaaggaaaccatcacccacccctcaggaggcaagagatggccccagctcagtgcccctgtgaggaaagctggacctacattcaaaaccagcttctgtcaaagacacattctgccatcgtgggcaatcaggctg

SEQ ID NO: 94604 - DNA, 340 bp, Homo sapiens
gaagacagaagcataatgtctgctaagcctctttgatttcaggcagcagagtatttcacacttaaaaaaaacctaccctgcctcatttactgagtgatctggaaagctgccacagaggaggagggccgagtgtaagaaagggctctgcagcagctctggccctaaaatggtaattttttttttttttttttgggacagaatctcgcactgtcacccaagctggagtgcagtggagtgaacttggctcaatgggacctccgccttccaggttcaagcgattctcctgcctcagccctagcctcattcttccaagtagttgggcctataggcctgcgccacc

SEQ ID NO: 94605 - DNA, 400 bp, Homo sapiens
cacatgacacacacagacatacacatagacacagacacacacacagagacacacaaaacagatcacacggacacacacagacacacacacagatcacacggacacacacagacacacacacacacagacacacactgatccagacacacacacagacacacacagatcacattggctcaaagacttcatcctctctaagttccattatttcctttctcaccaaaaccaaagacaatcgctgccagggaatggagatgcccgtgcgtgaaggcgcagtttggattccgatgttagaatgggagggaacgttgtggtataggaaaaatgccgtgtgtgtctgaggagagctacactgaggcaccacgcacgtttgcgctctgagcgaaaggctccgtacccc

SEQ ID NO: 94606 - DNA, 530 bp, Homo sapiens
ggcaggaaaatattaggaagacagcttcaaatgaagggactatcattgtgtttatgctgttcttgatcacatctcttaattgctttctctctgaatgtccgtgtataaaaaagaagctacaatgtgtgtaccctgcgtgttatggaggaagtgtttaaaatttgggtataaggaacaacaggactcagtaaccagccactccccaacccccaatgtcagtagaagacagatgtcaaaatatcatgatcaacttgaggtagcataaatcaaaacaattttgatagaattagccatctgtggaactcttcccgaaaataacaaaatttcaccagggagccaccaatctgaaatgtaattactctaagatgggctataacctaattaattgtaaccttgcctgtcataaggtaaaatattttgctgacagaatatttaaaaagagagctgggaaatagaacatttgtctctgttcatccaaaattacatgagagagatactccagtagcttgggtgcataaaagtttataatc

SEQ ID NO: 94607 - DNA, 284 bp, Homo sapiens
ttgaagctaagtgaagaaaaaattttaaaaaagaaacaaaattactgacaaacatttgaaatataaagacagtttttatagaaaaaaagaactttgaaaaaatgaatatatgtattaatgaacaactactatgatgcccttgaaattaattttgaagaatatttcaagggaggaaaaatagttattcactgaaacgaatagcataatatgaaaaattatagatatttaaaaataaaatttggatctgatatggtttggctgtgtggccccacccaaatctcatt

SEQ ID NO: 94608 - DNA, 378 bp, Homo sapiens
agtctgagtaaataattatgaatcggctctcagaattctccaggctcactgaattctgcaacctctggagagcattttaaatgctagcagaacattttaaataccactgataccccatgcatcataagcatccactgcaagagaattaccaggaaatttcagtgccacgtggcaaatactcaggcaattacaagcagaaatagtttcagaaattgtttcttcatgtgaaggacggtggaagaccatgccattggatgacaatcacatagaattggtcatgttgacacttatctgcctcatcctggagcacttctgggaagacttcatctgtttaagaaccataatctcagcaccctgagataaaacaacaacaacaac

SEQ ID NO: 94609 - DNA, 196 bp, Homo sapiens
ggaaaggtttttaaccactctgagacttagtttctttaactgtaaaatgagggtaataaagtactcactatagggttggcctacaagtcaggtagcatctggcacttagtaagtgctcagtaaacactagctaggctttaaagtgaactgagaccttcttagacactcctgactaaaatgatctagttgagatcac

SEQ ID NO: 94610 - DNA, 290 bp, Homo sapiens
ccccatctctctcctctcacccctcacctttgcacgctgggccttttctccacatctccgtggctctcatgctctttcctctattttttcattcttttcttctctatgcctcactctggatattttctgtcaatctacagtgcagagttcactctcctatgtgcaatctgctatccaatttatatttaattcttcatttcatttattgtatttttcattcccagaatttccatttaagtccagttttatacattcttttttttttttttttttagacggagtttcactct

SEQ ID NO: 94611 - DNA, 277 bp, Homo sapiens
agcaaatatgcaagggagatgaatgttggcttggacatgcttgagcctgaagccttgttttcatggcggtctcaggacccactgcaaggccatctccccttactgcaccttcaacaaggagcagagctcctctggcatggataggccaaagttctagaaaaactccacctcttggctctttgagcctggaaagggatcatttcctttcctctctgttctttccatttctctctctctcctttgcattctctgaagctttctttttcttttttctttt

SEQ ID NO: 94612 - DNA, 213 bp, Homo sapiens
ccggttcctctacttcccgccgcctctctggagcagactgggaatcattaggaatcgggtgtccttaggtttccacataggaggagggcccatctctgtctcctgcacttgcctgggaacagaaatctgccaccaacccttgtgctgacctctggctgtgtgtgcagtgaccagaggcttgggctcctctgaagggcaacagatctccagctt

SEQ ID NO: 94613 - DNA, 440 bp, Homo sapiens
tatccacctcactatgcagcccatcatctcaatggtgacagtgggccagtcccttcacaggacaactggttatgcaaaggtgtccttggtgctgggccatggcgcagaccagacccagtcccaactacaccaactagcacaccaggagaccacacccaagctgacctcagggagtgcagtgcattctcaaaacactatgtgaagctgttgtctttgaccaagcagggaacttgatcaaacacccaagttgagagcaggtgatgtggccacccgttatcatgctgatgtgctcctgaacaacaagcaagagtgggcaccttgaatcctgttgggagcttcaggtttgccaaaagaaacttacctctcccattttttttgaatataaacattaaggtcttttgaattatccttttttttttttttttttttgaagccaattt

SEQ ID NO: 94614 - DNA, 931 bp, Homo sapiens
tgcccctgctagggttttgcttggctttggaagcctttcatgtgccccgaatgctataaacccttgcaataaatgtgaagtgtatatagtttctgctacttatgggaggcattgagggagttaagcacagtggcttttgtgtctgcagatttgagctgaaattccagttctgcagcatagggcttaacaggttcactccccttccccatcctctcatcccccagggctttactctctcttccttccacctggatagatgcccttctcatcttcacacagcagaacactgcttgttctgagagctcgccctgctgattcttcttccatgagtcagaaagcccacttcacttataggatgagaacatggatttaaaatcagacaaatctgggttcataccgtccttttgctagctagacaatgattggagtttgtcagtttccttgagaaaaaaagggataatgatattcctaccttttaaggtaatggcagacattaggaaaatataaacataaaattattagtagagatttgatgagtagccagtgctcagtaataactaggcaattcttgattgtgtctgaatgagtttgtgagtgcatatgagagtgtgtgtatgtgagtgttatgcgtgctcacacatgtgtctggtaaagggcagatattcatatagctgctcaggttggtggaaataatttctttttacttttattctattgttcctcccaggactgagtttctggcctgtctcacttttgacgtctaatattgcgttggttaagagtgccttctctctcccccactctacagatattcagaagtaactgtgaagtaattgtggatgggatccatgtctacttggtatgtttgtctcctgagcatctgttgccagtgtaatttcatgacaatcatcaatatgtattgaataaaaca

SEQ ID NO: 94615 - DNA, 294 bp, Homo sapiens
agccagggaggcagtattgcaaggaagaacatggctatcaacacttgtttgtctgactcagaggaataaaacatagtaaattttgccttagcgggccacccacattcattgggggaagaaacaattgaggtggggggaaaacagaacagatgaaccttcatggagtttcacaagagtccacatggttgtgtcccttattttcagaaaatgtgaaattggaaaatacgcacttgtgaaagctgaagatgtcacagaaatcttcagaggatttatttagatggtcgtatcctccgc

SEQ ID NO: 94616 - DNA, 783 bp, Homo sapiens
gtggcccagggcggtgggctggggggtaaatggctctcttgtagctgatgccaaacgcttgttcctttgcctggtctcttctacaccaagccccgtgtgtctgtccctgaaggcagtctcagtgctggggcttgaagggagcttcccccagatgaaaccctgtctctcgaccttctcttccatccattgagcctgcttggacgcagtaaatcaatgaacgaccctagtgtttgctgtcccgggtgagccggcaaccatgggtcattgtttctggagaggaccaggtgctctgaacaggcagctctgggcctacaccccatctcaggttgggtttcccaagagctgacactgagacaacactgtgaacaggaacactgatgcagaagctgattccaggattcatctatgggaacaggggcatgagacagggcctggaaggagacgatgaggggtgtgatgagttgaggccatcagggctcagtccctctggggacgacagcggcatggtgtagagcagtgtcctgaagcccccgggaccagtgcagattctggctctgcaggtctggggtggcctgagacccctggagcaatgcaggtgctgttggtccaaggtccactccaactggaacgcacctcagaggtactgcgttattggggttgaaatgtgtccccctgaaacatatgctgaagtcctcacactcggtgcctgggaatgggacctcatttggaaacagagtctttgccgacgtgatcgagttaagacaagggcatactgggttaggg

SEQ ID NO: 94617 - DNA, 565 bp, Homo sapiens
aagaaagaaaaaaacccagcaaagacctaatggtgagccctgtttcactacccatccccagcagtgggctcagtctgcctgcaggtacagtgtcaatgcagcccataagggccttcctgttgtccactccatactcagcagaagctataggcctggtccgcccacatcaccagcaactgcagggaggcctgtcccctaccaggtaacagcaccagtggcttctatagccctggtgtcttgtaatcctctacccaggggcaggagactttcgtaggtttcagaacctctacttccttccccttagcaagagaaagcccccgaggtaggtgtttcctgctcccagcaaccccagcagagatcaaacaggaggtctgcctgggtcccaggcagccagagagcagtccagaggaagctctctattctatgtttccagcatcactcagcccctatgtgctgacactgggtgacacaggtaagtccctacagccctttcaggcagtaccaaaagggattagttagaaccttagcagaatcagaacacaacaggccataaatgcattgcaag

SEQ ID NO: 94618 - DNA, 369 bp, Homo sapiens
acagcagccaccagaaattaatatggggaggaaatagggatttcatctgtccatagtaaagacatgccgggggtgataagaatctgagcccatctcacctagatgagaacgagagagtaatgaccacagaatagtggtgatggccatcctcacatctggctccttagccacccatgccagtatggactgactgccttctacgtcttgtccatggccattctctagggaaattcccttgcatctcctgctacctttacagactacatattttgttggattactttctcattttcatgaagcatatcttctagtaacttctgataaaagatgcataggagataaatattttaggacttccacagtaccaga

SEQ ID NO: 94619 - DNA, 241 bp, Homo sapiens
gagccatgtccacgtttaatattccagaatgcagacatgtcttatgatatggagtgaggtggagattgggaggggaaatagaaaccaaattccatgagaggactctgagatgcttaagaaacaatacaaagaaaaaaagggcaggcatgatgactgaaacccaaccttcattcatcctcctcagaggagaacgtggttctggaagacagcatgatggttttcactgaaactttccatgatc

SEQ ID NO: 94620 - DNA, 778 bp, Homo sapiens
cagaagtacaatggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaccccgggaggcggagcttgcagtgagccgagatcccgccactgcactccagcctgggcgacagagcgagactccgtctcaaaaaaaaaagaagtacaatggataggggctaaaatcacaagacctgaagttatgctatctggagctgtattttttaataaatactcacctcttgttacttagatctcttacttgtaaatgggtgtaatgatggtacctgcctcatagggttactgtgaagttcaaatgagttaacaccattaatgataccaggctttgcaatgtgtttgatttagatgctaaagactatttattggttccatatttcaataattcactgaggagaaaagtgagggaggtaaacatagaatctgtgaaatcaaaatgcctttctagagcaagacaatcaggtttctatagtgaaacaagactcttaaaaatatgcttacaccaagcacagtggctcatccctgtaatcccagcaatttgggaggcggagcaggaggatcacttgagcccgggaattcgataccagcctgagtaacatagtgacaccccatcactacaaaaaaataaaaaaattagccaagtgtggttgtgtatgcctgt

SEQ ID NO: 94621 - DNA, 685 bp, Homo sapiens
agcggaggctgggaggagagaaaaggtctgcctttgacatttgtaactgctgagaactgaaggtcagatacagtcctttccactaagaaatggctgctcaccgaagagctcatgagatttgctactgctgtcacctctcatggcttggtggtctgaaaatattgtagaaagaaaagagtttcctatgcctcagcaacttgtgaaataccagattaagtttgtggacactgtctccaggataaaaagtttttaggctgggtgcggtgtctcacacctgtaatcccagcactttgggaggctgaggtgggtagattgcttaagcccaggaatttgacaccagcctgggcaacatagcaagaccctgtctcaaaaataaacaaatacataaataatttttaaaaagaagtttttaaggccgggcactgtggctcacacctgtaatcccagcactttgggaggctgaggtgggcggattacctgaggttgggagtccaacaccagcctgaccaaccctgtctctactaaaaatagaaaagtagccaggcgtggtggcgcatgtctgtaatcccagctacttgggaggctgaggcaggagaatcacttgaatctgggaggcggaggttgcggtgagctcagattgcaccattgctctccagcctgggcaacaagagtgaaactccgtctc

SEQ ID NO: 94622 - DNA, 495 bp, Homo sapiens
cgtgggattaagctctagttgcctacagtggttacttcttgataacaacctattactggctttttcaccttccctgcctcaataccctactccccattgtatattaaaccagtgcaaaagtgtcttgtgtttatatgtaaagaaaagttggcgtctggattcagataactacaggttttattgtttttcagtgacatgatagttcagtgggacatttgaaagttatacagggcatgaggcgattcttcactgtgtagggcaacttgtggaaaactttgcttaaagagcagtaggcatattttctttgcctgtgttttcttaatcccttcctcccctaccctgttggccgaaatgtagacgtgatgactggagctgcagctgccatcttgggagcaggttagacagaaccatgctacaccctagggtgacagagcagtagccggaaggaacctattccctgaggacttcatggagcaaggctgccctattagccct

SEQ ID NO: 94623 - DNA, 322 bp, Homo sapiens
ttgtctcagcctcccaggtagttgagactatccataggcacgtgctgccatgcccagggtatcactttgttgcccaggctgcctacctcccttttagatttgaagtcctttcaggagagaaactgagtttccttcctgaacttgaatgttgggtcctcccgaggatggccccctactgctctctgcttctatccttgggttccatgagcaaaaactaggcctggcccagctgtcccgctaggcgggattcctaaagacctaccaggaaacagagaaggcaaaggcagaagaagacataagaagtgggacaactctactcctt

SEQ ID NO: 94624 - DNA, 415 bp, Homo sapiens
gttgaaataagacatgtcacatcctttatttaggaatggtggtattacagcaccagacaagcatctttaattgaaggaacccatccgtcctccttcccttcccacccaggatcacgttagtaaatccttgcttacctcgaaatgcttgagagagagtggttaatgtataaatcatgcccatttatgatttggaaatcataacttgggaaagcaaacagaaggacgtccaggactgaacaggccatagctttttcatattggagtctgccccttctcttctgtctgtgacctcagttaagttataggtcgctgctgggctttggtttcctcattggtaaaatgaaggccctgggctagcggatgatctccagggtccattccagctcttactcttgacgctgacccagatgctact

SEQ ID NO: 94625 - DNA, 260 bp, Homo sapiens
cccacctcatctttctctgcctcatcatgtcagaaaaagtaccccaccttttgccacaaggcaaatctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagctactcagggtgggg

SEQ ID NO: 94626 - DNA, 453 bp, Homo sapiens
ggaactcaaactaagacaatgtctctgcctcttgtttgtctacgactatggtcaggatcacaccattgcactccagcctgggtgacaagaaagaaactacgtcaaaaaagaaaaagaaatgagtttcctcctccatacttgcagagccccagtgagtccctgctctgcaatgctcatacccattgtgctgttactgcaagtcaatgagaacgttggtggacttctctccacttcacagaagaatgaatggaggcccagaacaatggcatgaacctgtcgtttcttggccttttggctaagatcaagtgcaatggcatgaacctgaccatagtcgtagacaaacaagaggcagagacattgtcttagtttgagttcccacttcagaaaaccttgagacaaacattgtagcacatgagaccttgtcttaaaaaaataaaaaattttaaaaaaaaa

SEQ ID NO: 94627 - DNA, 529 bp, Homo sapiens
taaagccccgtctctactaaaaatacaaaaattagccgggcgtggtggcatgtgcttggaatcccagctacttgagaggctaaggcaggaaactcgcttgaacccaggaggcagatcttgcagtgagctgagatcacaccattgcactccagcctgggtgacaagaaagaaactacgtcaaaaaagaaaaagaaatgagtttcctcctccatacttgcagagccccagtgagtccctgctctgcaatgctcatacccattgtgctgttactgcaagtcaatgagaacgttggtggacttctctccacttcacagaagaatgaatggaggcccagaacaatggcatgaacctgtcgtttcttggccttttggctaagatcaagtgcaatggcatgaacctgaccatagtcgtagacaaacaagaggcagagacattgtcttagtttgagttcccacttcagaaaaccttgagacaaacattgtagcacatgagaccttgtcttaaaaaaataaaaaattttaaaaaaaaa

SEQ ID NO: 94628 - DNA, 342 bp, Homo sapiens
cttgtacccatatcctcaggtgcccttggccattcacccttaaggcacctggctcctgggcttatcaccctgggaacgacctccagattctgaattttttaacctttatgtctctttcccctttgtccctttcatcaaatcacatttgtcctgtcattcagagatctgctatctgttgcaggatcaactgatctcagaatctaattttcatgaagatgtttgtagatgatactgtgctaatatttatcttttcatctttccatatgtggaagtggtctcaactgagactgaaattcaggcatacttggcacatttttatcttgtgcttgccagaagcatgtt

SEQ ID NO: 94629 - DNA, 654 bp, Homo sapiens
aggggaggagttaagtgtggggccattgtcagtttagcttttggccatcccaggtgctattcatttggcgattcggcaaatgtttattgagcaccaactatgtgccaggccctgtgctacatgctgaagatgctaagataaacaagataaggtcaaggacattgctcttgtagaactcttactttaatgggagagacagctagcccgagaaacaaacaagattatttcagggattgggttaaatgctgtacagaaaatgaaactgagtaatggaatatctaggaagcaactatatgcatgggccaactcagttactcagctttgacactgttgggtctagttggtacctttgtttccttttgtgttatagatggaggtgatctttcaaatctcctctgcagagatccaatgggataatggttgactaccatttattgagcacctagcccatgtcaggtactctacatgcattttctcatttaattccctcacctagactgtgtgctaaatggtccattagccctactttcttttccagtaaagaaactaaggtttggataagtgaagttgcatgccagggtcctgcagctttacgtggtgaatcctggatttggacctagattgggctggctctaaagccaggcttctttcccc

SEQ ID NO: 94630 - DNA, 378 bp, Homo sapiens
catgtagggggagagaaggggcaaggaggggaagagaaaaaagaagagactagaggtgagaagggagacatttaggatctggggctaagctggcacagattctccttcctgttctaaggaggctagaagtgcatcctggcgatggctgtggagggagaggaccggctgtctggatgctggtcagtgtgtggaaacagagggggctgtgctgccaacccaggcatctatgacatcagataccctcagcctggagggagtaaagagccctctttcccagccggtctggactctgatgactagatttccttacagccattcatcaaaacaggaactgccctcatcctacaaaatggcttttcaaccaggacaagagcacag

SEQ ID NO: 94631 - DNA, 343 bp, Homo sapiens
aagccatttgcttggggcctctgaaggccaaactcattaactaggaatgattaatggagtcctcctgcttgtttattcagctcaagtctatcaacaactgcagaagtattttgttttccgtctccctgatgttttcgttctgtcttctctgctaatcctgcccccttctctgccaaatcccctgctctgctcttgaccttgctggctggccgcctcctctccctggactcaccctcctctgcttgaccttcagagacttttcccctaccaggttctggggacccacttgggacaatgactctgaagacttcggcccgcggggagggggacaaagggttctccc

SEQ ID NO: 94632 - DNA, 311 bp, Homo sapiens
  misc_feature (19)..(20): n is a, c, g, or t
agaaggcaaggaatatagnnaaaaatctgtgcgatccggaacatggataagctactttgatggtaatgttgagatgagaaagacattccagaaggcaaggaatatagtttgtagtctgtgcgatccggaacatggataagctactttgatggtaatgttgagttgagtgtaattttttaaataggtatttgccggttttgaaaagaaaaagcatgtttatctctactattgagagaatcttatttccactaattgcgtttcactaacatataggctttctttcaaaacacaacagaaaagagaaggaagat

SEQ ID NO: 94633 - DNA, 504 bp, Homo sapiens
ctatcgtcatagctgattcttgaggatcaacccgcggcgagttcatgcacccggtgggtgttcatgacagtgtgaggacacccttggtgtcaccaactacagaggcatcccacctgctacaggacctggcaaaacaaaaggctctagacaggtccataaaagggtttgccaaggttggggtgcgggggatttccagagtaatctgcatagcaaatgcccacccactcctgcttgtctatatcaagacagctaacaagggagagtgaagagaggggctgtttttagtagaagtaaacctttgtcaagaaggagctgtatttctttctttctcttcactcacaagataggggcacctgagggaattgcctatgcattgtgagtgtgtctgcaggacattccattcctgtgacccatgtactgtaggaccaaaatcccacctggtctcaaccaaacacatgacttatcaaacatgatgagtcagaaggggcaaagcttgcttcctcc

SEQ ID NO: 94634 - DNA, 328 bp, Homo sapiens
aacattgccctcagattaaaaaaaaactaaagaaagatctgtttaggaatgtgcaaatacaaccatattcatggatggatgcttaaaaatagtcacgtacctttgtagttttgtgtataggtgtgtgctttaaattttcacctaacaagggaactgttgcagatgtccttgcttttgacataatggctctgatttaaggcaactagcagactgtactgagaatctcccctccttagctttttttcttaactcttctttttcagaataatataaataattcagaaatctttgtcagtgttaagaattaacaggaaattaatgtgtatat

SEQ ID NO: 94635 - DNA, 516 bp, Homo sapiens
tccctgcacagatgggacgtggcttgggaggaatccctggctgcaggcattccttggcccagtggccagatttctggcacttgaagcaagatcctgagagaggaggtcctgtaggaatgcctgaccactgcagcttaggcgttttgaagttcttgtgtgctggagctgcagctgagttttgtctcacagcagaggcaagtaattgtaactcagaaatgcattgccatttggctgcctcctctctattattgcacactttgaaggtgaggttgattaattcctgttgtggggtttgaggactggattccaatttttgaagcttttttctaatgtcaggagctgactggttgataaaatgcatattgagaatgagacagccttctgacccttcagggtctagggctgtaaagtgtctcagaattgctgccagatgaaccatgaactgggctgggttttcatctttaccttgggtcgtttaagtttgtcataattaacagctttgtaagctgccttttt

SEQ ID NO: 94636 - DNA, 782 bp, Homo sapiens
ataaggaggcagataaactactgaaaaatgctctgcttggtttctctaatttagcttcaaatgatgtcataactgagcataatatgacatttaaaaagggacttagcactccctcttaaatatttaaataacaatgtacatgttaattagtatgcatttgcctgttaatagacttattaacatgtatgctagtagtcaagagtactgagaaatgcctgtgcaggcaaaggtgtcttgattcaggacaggcaatgtgaggtactgtagtgattagcaatgactgacagtgcactaatcacagcccttgttgagcaatcagtcttcattaggctccccaaaccaaaactgacccaaaaacaattgattctttctggctttaaagccaatttctccatttgttttgatttgaggctttttaacgctgaatctgtgtgtgaaaggcccttctgtttaatattttagttgcagtgcagttaataaatccttgactttattctaaaagtagagacaaagttaagacttctccaggagactaaggaatcttaatatttacatgagggaaatatacacagttataatcctgaaaattatgcaatttccagtcatttaaaaatcaccacaaaatcttattcttataaaaatctagcttaaagcacattctcagtcagaattctggctttaaaaatattcattgaataagaatactagaggtctttggaaagtataggacatgatactgatctcttctcccagtaaaagaaagctgctttagagattaaaaa

SEQ ID NO: 94637 - DNA, 492 bp, Homo sapiens
aaagggtactacgcaacaataaaagtgaacaaagcaagctactgacacacaacaacatgatgactctccgggtcacgacgttaaccaaaaaataagacaaaaagagaatatattctatatgattctaattatatgaaatccagctgcagacaaactaatctgttatgttaaaaatcagatagtagtagagatggggtgtggaactgactgggaagggactggagggaactcttccagggatggaaatgttctttaagggggtgggggaacagggtatggttacacggacttttacagttgttagaattcatcagattcaacacttagaatgtttattttattgattgtattgtatgttaattatatctcaatttccttaaaaacttacacacacacatatgcatgagtcagcccacacatgtagaagactgaaaagatagacaccaaaatgttagaagtgatggaattaccagagtgggttttgttgatgtt

SEQ ID NO: 94638 - DNA, 520 bp, Homo sapiens
taacctacagtaggtgccatgaaatttagcagttggtagtgcatttctttgctctctagatatcatataagaaaaagcattgaaagtgatacagaaggagagaacggtgtggtccctggctaggactctaacccaggcctgtgcccacggacctaggtgcggcatttttattttcctgcccaaatgttgcatctcccaagaccaccgtggcctgccatgcccctatcccgtgcctataaaaatcctgagaccctagcaggcagacaaactttgagaagagcacaacaggggaggaacacacgggtggctggatgccgagaggaatgcactgacaggcaccagcaggtctgcaggccatcgacctggcagaagaggcagagtttggctgggatggttggaggagaacccaggccgctcagtgtcctgactccagaggaaaaccttcccgctccatccccctctggcttcccccatctgctcagaaatacttccactcaataaaaccttgtactcattctcc

SEQ ID NO: 94639 - DNA, 711 bp, Homo sapiens
  misc_feature (71)..(71): n is a, c, g, or t
  misc_feature (73)..(73): n is a, c, g, or t
  misc_feature (77)..(77): n is a, c, g, or t
  misc_feature (84)..(84): n is a, c, g, or t
tgtccggggttgtttaaatcttttctggtttttccggaaacattcaccaggacactatgccatgattcgantngacncgtaccntcgatgtggctcagagcaaggaagataggagatgggactgcccctctcctggagtcaggctggactggggggagcagagacccccagccccccagatggagtgggatgggtgaagtgactactcaagggctttccaacagctgcctcctcaccctcccattggctccagccaaacagcccctcttggcctctgcggagccccttgagctccaagttccgaaaaagcccttccttacccctgccctatcactccccttggggcagttcagagctaatggaacagccaaggagaaagcagaagaatcaaagaagggcgcggcacagtacccaggagaattcagggtaccaggttggctcacctcaaagaggagaaggcccctgggggcactggggtggggtaatgctcagagaagcagcctgtaagattcaccttcccagattctgtcacctcagggaggcacttggtggctccatgggaggattccagagggggccaaaggatctagcactcaggccaacatggcagggcctcactccttgggtacctagcctcctgtgttcccctcctatccccggccgggaggcaggtggggagggtgcctgctccacctctgagcccacatcgaa

SEQ ID NO: 94640 - DNA, 916 bp, Homo sapiens
tacggtaggtacagctacgggtgaggtacagctacgggtggttccagcttcctccagccacacacacccaggtgtgtgcggagggggttggagaatcctgaaggtgagagggaccttactgtatgcaaatgaaatgcaaattagtacacaaatgagcaattctgccagccacctgcttttaggtctggtccagatcacaaaatccaaaagctgaccccttccagagcagtactgaacccatcccctcagctgcagccagaaggagggagagtaggtggagggatgcctagatggagctcttagagcaaggaagataggagatgggactgcccctctcctggagtcaggctggactggggggagcagagacccccagccccccagatggagtgggatgggtgaagtgactactcaagggctttccaacagctgcctcctcaccctcccattggctccagccaaacagcccctcttggcctctgcggagccccttgagctccaagttccgaaaaagcccttccttacccctgccctatcactccccttggggcagttcagagctaatggaacagccaaggagaaagcagaagaatcaaagaagggcgcggcacagtacccaggagaattcagggtaccaggttggctcacctcaaagaggagaaggcccctgggggcactggggtggggtaatgctcagagaagcagcctgtaagattcaccttcccagattctgtcacctcagggaggcacttggtggctccatgggaggattccagagggggccaaaggatctagcactcaggccaacatggcagggcctcactccttgggtacctagcctcctgtgttcccctcctatccccggccgggaggcaggtggggagggtgcctgctccacctctgagcccacatcgaa

SEQ ID NO: 94641 - DNA, 199 bp, Homo sapiens
tgttgggattacacgcgtgagccacggtgcgcggcaaggtaaaaacttttaagtatcgcttaaacattacaacagtccaattcatttaaattaataaattcaagagactgcaaagactaagatccatgggtgtttttgttttgttttgtttgtttgtttgtttgttttttgagatggagtatcgctctgtcgcccaggc

SEQ ID NO: 94642 - DNA, 622 bp, Homo sapiens
tctaggtcgaggccgacgtcgcttccggagcagcatggcggccactgaggaggagaggctagcagggagcggtgagggagagcggctggatttcttgcgggatctgcacgtgcgatttttccagcgctgcctcgaggttttgccggagcgctgttcttcacttgagacaagcaggtctttcccacagaagacagatcaaatctaaatcgctgtggtttccgaggctcttcatacctgggtattcttttcaatccatcaaaggctcctggaacagctcatccttatgatagtggccacattgcaatgacctacactggcctttcatgcttacttattcttggagacgacttaagccgagtaaataaagaagcttgcttagcaggcttgagagcccttcagctggaagatgggagtttttgtgcagtacctgaaggcagtgaaaatgacatgcgatttttgtactgtacttcctgtatttgctatatgctcaacaaccggtcaggcatggatatgaaaaaagccatctcctatattagaagaagtatgtcctatgacaatggactggcacagggagctggacttgaatctcatggagggtctactttttgtgccattgcctcac

SEQ ID NO: 94643 - DNA, 301 bp, Homo sapiens
aaaaaggttgagtttctgatcctcaaggtaaagtcgatattaatagttaactaaagtttcctacattctggcccctatctgcctgtctgcatatccacattcataccattcccttccaacctccatgcatgctgttttctatcatcatggtcctagacctagaatttcctttttcattggacaaatattttaggtctctgtttcagtcagagctttccctagttcccccaggcaaactctgtatttgtttctgtttctagtgttcattggttatagcaattattgtattaaatttgctgtt

SEQ ID NO: 94644 - DNA, 210 bp, Homo sapiens
ggagcagaaaatcgatgccttggctgcaggtgctcacaatgatgagtgctacgggtaattgtgtcaattagagggccgggacataaatatttgtgtgaaaaggctagctgtcgttaatctttttttatttccacaaagtatgagaaaacaagcattaaagacaatggtctaaggtgagttagacttagttatatttataacaaaggagct

SEQ ID NO: 94645 - DNA, 806 bp, Homo sapiens
cctcctgggatgaccttgggtaatccgctacccttgagtgtgggctgaacttacttctaatgaataaggatgtcgctactgagattaggttttaaaacctaattctactgagattaggttttaaaacctaattctactgagattaggttttaaaacctaattcttcttgggtttcgtttttgggttctctatggttctcccacgcttgatcaccaccttccatgttctgaggtcccataggcagcttcctccttggtcttgaggaatactctcatgctcagaggggcatcctgtggtaaggaaggggcctaccagcaaccacgtgagtgagctgaatcctttggcctcaatagagttgagatgactgctgccccagctgacagcttaactgcaacctgaaatatcttcagtcagaagcacccaacctcatgcttctggatttctagcacacagcaactgtgagataataaatgcatgtttttagtcactaagttttggattattttgttatgcaataatagatgactaatatatcctgattataactttgcaaaagcatatgccaggatgacccccatccaatgactgatacctgtggaggtataaaggtctagccatctcagcccaatgagggacaattctgaaggaccactttagctcctgacctctctgtggggttggctgaggctgccattgaatctgcattgcagctcaacttttccttttgcccgctcttgcttttgtcccctcccttacacaggtgttgactcccagggaacgccttaataaatattctgcatgctaaa

SEQ ID NO: 94646 - DNA, 394 bp, Homo sapiens
ctgccctgacactggtgtgacctggggcaagcggcccaacccctcctagcctgttcctcttttgtcagatgggggtgatgactgcactcccctccctgggttgcagtgattctgagagagccagtgagcgattggtgcctgggaaatgcccagcccagtgcccaggggccgtttccgggagcggactccggtactgtctctccctctcccgctgcctcacacgtcctgtccttgcagtttctccttccccagcacctttcctttttcgctatgtgaggccttgaggactctctggaatttaacatcattatcgccgtcatcacacccctggccctgacttgttttctctgtgtcccaccctacattgcagactcactcagggcggggactccgg

SEQ ID NO: 94647 - DNA, 435 bp, Homo sapiens
tgtggctgtgatttaaacaatgaggactctggtaagaacgtcctggcctcattggtgaactaggactgcaacctgaatggagttattgaataaattgatagcacagttttcagacacctgcccccttccctccatgccatgattttccagttgcttgctctgtggccaattttggggtagatccaaacttgcttcttcagcacctagcaacaatctcaaatgccacaagaagagttttaatttaatttagtgcacggccacatttagtaagtttttgagaatgttcctaatttattagcttaaaatcttatcacgatttttaaatccatcacttctcttcaaagaatgatgaattaaaatgtaggtaaatttttcttactttccttgaatgaaatacactgagagcagacagtctgattgacactgttatgtatg

SEQ ID NO: 94648 - DNA, 482 bp, Homo sapiens
cttaccgagatattattctctcaaaaataatataacttcacaatctctagtaggtctcctctttttcttcctttgtgacttattatttttcttcattgcatttgtcaaatttgtaatcatacatttatttaggggattgtttaatatctacctttctgcatattctctaaatattttcatttactataatttcctctctgcctaaaatcatacgttatgtggtaaataatatttgttaaatgagtgagtaaatgaattctttaagcaactaattatttaagagctgtagggattacttcagcttgggagaaatgtgatcagatttacgtattggaaagatcattttggcaacattataaatgattgattggaagaaataagattggaaacgccaagaacatctaagaggccattgctatagtccacctaagagattatgaaggatccaacctaaggcaatagtggtgagaagtgggaatgga

SEQ ID NO: 94649 - DNA, 459 bp, Homo sapiens
  misc_feature (431)..(431): n is a, c, g, or t
  misc_feature (457)..(457): n is a, c, g, or t
cctgggaggcaggggttgcagtgagcagagatctcgccacttgcactccagcctgggtgatggagcgagactctgtctaaataaataaaaatacaaaaattaggcctgacctcaagtgatatgcctgcctcagcctcccaaagtgttgggattacaggccactgcgcccagcctaaaacaacgtttgaacattagaattaagaattttttttttgtagagattggggggtgtctcactatgttccaggctggtccagaactcctgagctcaacctatccttcagccttgacctcccaaaatgctgggattacagatgacagccacctaactcagataccactttctttttaaatatagacttcccgggccaggtgcggtggctcatgcttcgtgactccgcctgcctcggcctcccaaagtgctgggattncagatgtgagccgccgtgcctggctntc

SEQ ID NO: 94650 - DNA, 419 bp, Homo sapiens
ccagctgctgtcattcaatggatagtcgaattcaatggcgcccaccaaagacaatgcaaaactctctgtgtccatgtcaccacaccactgatagccaattaactccttacattcagtgtaaaacatcagtgatttgactctcatacgcgcatctggggagagaagacaggaagaagaggaagctaaccgtttccagatctgagtgccagctcaaaataaaaccagtatcatctgccacaagtgcttttgacatgggtcctaattttaaatttacacacacacaaacatttatgtatgcatgggtgtgtgtgtgcgtatatatatatgtacatatttgattgcttctgtttaaaatgtactcatctcagcaaagcttattttccttttatttgactttcattgtgacgacaaaacactac

SEQ ID NO: 94651 - DNA, 1423 bp, Homo sapiens
tgttggtgctcaacaggttttagatcttggagcatttcagatttcagattttcagatttgggatgaccaacctgtatcgtcataactattgctgatgttcatttggtcacctggctgatgtttaacaggtatttaccaggtttcttttctgtgaagttactctttctcccgcttttcatactgtagcctttgggtaggaaattaccatgttcagcccacacttttaaggagtggggagttaaggcttcactttcttaagagaaggatatctacataaattatttggaattcttctgcacgggagatttatctcttctctctcatttattcaaccatttatttctatcaatatggactcgtgggcatttattttaatactttggtttataatacaataccacgtttttctgttgctttgttctagcttcagcttttgagggctatctacttgattcctatgtccctttgatatatccttatttttgtgggttttttttttcagggggagcaggcgcttttttattttccggcactataatatattctaggcttatcttgtgtattttctgccccagtcctagaatcaggcatttctccaaggaacattatttttatggagaatgaaagaaaccaagatccgagtgctttccctctttttaattgctccaaaaggtatctgactatgtaaggcaaaaatagtaactgtattttgtttctgtagcacatgtaaaaataaaatatatgacaacaaaagatgggagggaggaattgactctacacatgatgtaaatattatttgaagatgaactcaaggtaactaaaggtgtatattataaaccctagtgcaactacagaagaaaattttaaagaagtataaataagtcagtagaatagataaaatagaaatataaaaaatgctctactaagtagcccaagaaatgggagaaaagaagacaaaaagcaagataatggtagcttttaatccagtcatataagtaatcacattgaatgtggtgagaaagcgtcagttaaaagattgtcagatttgtgtgtgtgtgtgtgtgtgtgtgtgtgtgtgtgtgtgtgtgtgtgtgtgtttcttaaaaagcaatgtggtggctcatgcctgtaatcccagcactttgggaggctgagacaggcagatcacctgaggtcgagagttcgagaccagcctgaccaacatggagaaaccctgtctctactaaaaatacagaattagctgggcatggtagcacacgtctgtaatcccagctacttggtaggctgaggcaggagaatcacttgaacccgggaggcggaggttgcagtgagccaagatcatgctattgcgctccagcctgggcaacaagagtgaaactccatctcaaaaaaaaaaaagaaaaatgctgcttacaagaaatcc

SEQ ID NO: 94652 - DNA, 138 bp, Homo sapiens
acaaggatatgtgttagcagttctgtaactgcatatatgctagggttgaataagtaagtcagtgcatcatagatgatgagagccaggtttctcactttcaggtaaagaaattacagctaaggccgggcgcggtggctc

SEQ ID NO: 94653 - DNA, 634 bp, Homo sapiens
ccacgtgtgaattctaaatgacattgaagttcagatgaaaaagctctctggctacattaggtttctgatgcaagagacagactttttttgtttttgttttttaacttacgttcccacaaaacaaaagagacagacttggtgggtaggtaaacgttaagaaaataaattattaaatagaataatatctaccagagggcacagagaataaggaactttgtctacctgctacccagccgaggaagtaaacactgccaaccggcggaaccccccgccttgtgctctgccctcagtgtgctcttccccatgtccactgttgtgaattatttatttctctaagtaggcttttgatggacaaaaatgggggctcaggaggaagtgacacaggcacagaggcaggaaagcagggatgggttgtccgacgagcgagttctcgtctactttggccagatggcatgtacttgtgtgtagagaaatgacaagaaatagggctggtgagggggagtgccagggtgtgcgccccatggtggttaatttaggaggaaacaaggagcttcgtgatgattttggagcagagaagcagtcggatgaaactgctcttttttttttttttttttgagaccgagttttgctcttg

SEQ ID NO: 94654 - DNA, 366 bp, Homo sapiens
ctgggtcttatgggcataaaaactaactataaaattaatgtcaattgtgacaactaagaaaaggagtcatcttatttaaggtttacaatcaaatcaaatattccggtaccgtcctcaatggtttaaaagttgactatatatgcaaactaagagattgagaattgcagagaaaaaatgaaatcttgtcacttttaatttttacttggtcaaaactttggctttcaggcatacctacaattttatatttaattcattaaaacatgttttaatagtcaatgtcactgtttttaaattaaatccaaaacactagctgataaacaatgtttaacagaagccatattgatacactaagtatttattgagcat

SEQ ID NO: 94655 - DNA, 159 bp, Homo sapiens
aagctaaaagcaggcctaagtactatccttacttggtaaagccttgtggatcataagctagaattatgaaagccagaggagagggaagaactaaagggaagggctggttctggaactatgaccatattctaagtttgaagactatgcaaaacaaaatag

SEQ ID NO: 94656 - DNA, 406 bp, Homo sapiens
gctgttgtgatcaccaaagcaacactatccgtttaggtgctggattagaatccaggcgagtccgcagtatagtctttacacttcatcaacttccacacaggacataaattgtactaatatagtaatatactgaaatctcagaccaactgtttgtcatcggattagaatgtgatgacacagaataaagatgtgagacagaatctgtgctgaggtctaaattcacattggaagtctgggaagagaagactgtttataaaattatagcccaggaattgctgccaaagtcggcctttggtgcagctgtaagtcggatggaatccaccttcctgacgtcagacccacccactggaacactgctcctctgactggggcttccctgaatggaaactacatgtcatactgcaaa

SEQ ID NO: 94657 - DNA, 678 bp, Homo sapiens
agcggaggagtttttggatgtttttataaaatgatcacaaaactgaaagcagaaatttttcctggaattcaagaatgattcaatatttaatataatccctttgtatcaagagaagatgaaaaatcatatggtatctccatagataatgaactgtatttaacaacattcaacaacctttcttgattaaaaaaaactaaatacagtaagaacaggtagaaaattccttaacatgatcaaatatatctgtctcaatccaaaagtcagaataatgcccaatggtgaaacattagaagaattcccaaaaaaacacatcaagtatgtccactattttctctacaacttaacattgtcctgaaggtattagctaacataattagccaagagaaaaaaaataaaaaatatcaaacaagaaaaaaaaaaaacaaacgaaaaaaacaaaaggaggtggtaaaattattgctatttacagattatatgattgcatacttggaagctctcaaagaatcaaccaaaaaaattattacaaacaataagactattattgtagttgaatataaaattagtatagaaaatcactagaaataccatttgacccagccatcccattactgggtatatacccaaaggattgtaaatcatgctgctataaagacacaagcacacgtatgtttattgtgg

SEQ ID NO: 94658 - DNA, 463 bp, Homo sapiens
taaagcttgttataataccggtggtttcccaagttcagtgttcctctctcctgtaacacacaccactgtatgtacctttcactgtatgtaccctctacgtcttccctatgggacttggtcagagaggagacctgcagcaaacatactggggctcatgctgcttgctttgctgtgactcaggagtgtttgtcttctgccagcatccatgaaacaggaacaggttaacttaccagctgataatcaaatctcagacccaacagacacattggcctgaaataatctcagtaaatgaaagtttgacagtttaggaagcttatagaagtcaccttacatagttaatttaaatcgaaggtaagaaatatgactagtattagtaatttttttcaggatatggaacctcacatttgcaaattgtggatgtcactgtagtctagccttttcaagatcaccaaaaaaaaaaaaa

SEQ ID NO: 94659 - DNA, 446 bp, Homo sapiens
ctgctgatctcatgaggtatggcgctgcagctggaggcgacccacaccttagtggatgtggggaaatctcctcagtgaagagtggatttgtggagaccatgcatccacactggtggcacttgcttttcaataattttattgtcgtgggacatacatgagtaaaaatggaaattccaaataggatcaggcataggggcgtttccttaatttgacctaaaacatgcatgcctggagattctcattggtttaataagacaaagaaagaaagtcaaagaattattgggaatattcagctaagagtaacaggaattcttccttctatagacagccctgtgatttttgtggtgtttaaactttgtaaaatctggattttatcaggacaagtgaaaaattgcagaggactaattcctaaatattagtgagtgtttaaccctccgccaaaaaaa

SEQ ID NO: 94660 - DNA, 708 bp, Homo sapiens
atgaagtcctgtcatttgcagcaacatggatggaactggaggccattgtgttaaatgaaataagccaggcacagaaagacaaatattgcaactcatatttgggaactaaaaaaaaaaaaagttgaactcatgaaaatagagagtagaatgagggttaccagaggctaaagagtggagagccagagataaagaagggatggttagtgggtacaaaatacagttaggaggaataagatctagtgttcagtagcacaacagggtaactatagttaacaataatttattgtatagttcaaaataactaaaagaatggagttggaatgttcccaacacaaagaaatggtaaatgtttgaggtgatggatgtcccagttaccttgatttgagcattgcacatagtatgcctgtatcaaaatatcatgtgtaccccataaatatgtacaatgattatatatccataattaaaaatttaaaaataataaaaatagtaagattttactctgaagaaaacctaaagattatttgaatttggacacacctttggcccctcgagtttcagaaaaaggattgtaaatcatctttttgttctcagtgtctgaatacgtggggcatgaagtcatgttctgccctttctgacctgtctcttctgcatacgacaatgtccgtgtgtacacatctacacatctacatccacacatggtggaaggtg

SEQ ID NO: 94661 - DNA, 593 bp, Homo sapiens
cttgctctgcatcaccccaactacaccacacacggacagcttctgggtctctctctccacaaggaggtgttccaggtgcggccttctcaatggccctgggcgcttctcccaggcacccattgattcttacctctaaggtcctcctggccaatcctggccaccattctccttttgtccaggggaacctggactgtttgtggctgtagtctccaccctgtggccctgaggtggctccctagcgaggcccgcctcccctgcgctgcggtgaggctgagatgaggtcgtgtctttaaccgcccctggtttccaatgggccaagagccttcctagcctcgcagagcagcctggcccagcttctcttttgctcctgtgattcaacacctgttacaggacccctcctgggcacccctggccttgagctgggcccgccctggagttacgtattgtggcttgtgtggagccagcagcctgcccaccatcccctccctccttctttggaggcagatctctcgtattctttccctcccagctgcttctctccgtctctgtcaccccaggctggctgggcaggtctgcccgagccccatctctct

SEQ ID NO: 94662 - DNA, 920 bp, Homo sapiens
tattatgcactagtagaaggacatattttcttcacactttattaattaatctatttcgtgaatttttcttttcaaatgtctatcactgtaattatctttgcttataccaaattcagtttcactggattacttagaatgctgatattcaaatagttttttgaagctcagatttcaggctttgttcagttctacttacagtatttattacgattaatcattattccacctgcctctgagcaccttttacctagtagtagcagaggtgagtccagtctcgtgcaggaagaacaaggatgtgtttggcaggtaagctgattagtgagtctacatcaagtgattgagtcaacagttcataccaacatagctagagcaatgctttttgaactatgggcagctgtccttcctcttgatgcatgcctctttaatcatttccagcattttcttttccatttgttattttcaccagggaagagagagccttataatattagtctgttatgttagctttccatagatgtacacattatttaaatcatatgtaaattagatccatccttcaataaaaattttaaaactagtaaatcatctcctaataatttttcaaaatttaaattactgttaatttcagataaggctaataggcaatggttttcttgttctacaatactcttaacctagaactaagccatgttctctaataaccagatctcaaggtatatgaattttctttcattattggaaacatggttagagtgacctaaagctccaacttattattacatacatggaacccaatctagctagttctttcttatttaaattatctttccttagagccctttcattgttcctcttggggaggacttaaaggttttcttggttctagtcacaatcagaaaatatataatgaattttttaca

SEQ ID NO: 94663 - DNA, 160 bp, Homo sapiens
atccacttgcctcggcctcccaaagtgctgggattacagacgtgagccaccgcgctcagcccagtagctggctctttattcacactctgtggagccacacattgacctccgcccagccctccttcctctggcttatcacacgccctgcttccaaacacct

SEQ ID NO: 94664 - DNA, 269 bp, Homo sapiens
tagactgataatgtccttaatgtgccaggaggctttctgtgctgtgcctcatggccaattatacaagttcattcttccacgcccgcctctaggttcagacgtgaagtccatgttgtgaatgtaaaagcagacccctatgaccttcacgagatgggtttctaaacatacttagaagcaagtccccacccccacaatcctcactgtacacacagaaaacagacagctctcctgggataattcagtatagcccaattcctaaaccaatcccc

SEQ ID NO: 94665 - DNA, 351 bp, Homo sapiens
taattggcctaatgcttcctgataaccttgaattttgacgtcaaatatctaacaaatctgaagcccttgttgtcacttgcaaaatagctacccatgatcaatatgttactatcaatatgtactattcacccaaggtagcatatactctcctaggcatattatatgtatttttaaaatcatccatgccaatatttccattgataaacatgtctaattaaacttttttaaagaatatgcctttgagagtcaattatttttataagcccagcagtttaaatttaatcattatctgccaggcatggtggctcatacttgtaatcccaacactttgggaggctgagtcgggtagat

SEQ ID NO: 94666 - DNA, 395 bp, Homo sapiens
cagggccccgagagcacagtgatgcctgggtctggagctgcagctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttc

SEQ ID NO: 94667 - DNA, 946 bp, Homo sapiens
gccgtcgtgtcgagcctggtgaacgggtccacgttcgtgctacagaagaagggcatcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacgactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggccttggtggacttcttggggatggcctgtggattcacgaccgtctcccgtggggattgtccttatacaggtgttcaaagagttcaatttcaaccttggggagatgaacaaatctaatatgaaaaccgactagatgcaataggagcttggatggttcgaggaataggcattggaggtggtttctggccg

SEQ ID NO: 94668 - DNA, 894 bp, Homo sapiens
cggcgcgccgggcttcgcgctccggtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacgactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggccttggtggacttcttggggatggcctgtggattcacgaccgtctcccgtggggattgtccttatacaggtgttcaaagagttcaatttcaaccttggggagatgaacaaatctaatatgaaaaccgactagatgcaataggagcttggatggttcgaggaataggcattggaggtggtttctggccg

SEQ ID NO: 94669 - DNA, 495 bp, Homo sapiens
gccgtcgtgtcgagcctggtgaacgggtccacgttcgtgctacagaagaagggcatcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcggacagatgcccaaatccttgcagagaagtgtgtccatgatgggtgtattgaagtttacaccttagagtcacgtaggcattaaggtccattttagcttcctatctcctgaaggaaaagctcaacatcttgggcaagttggggtgcctgctaagctgtgcaggctccgtcgtgctgattatccactccccaaatgttggagatgctccaccttcggctgggggaagaagaaacaccttcccacccctcttggggtggggcctcccttggacatagcgcccact

SEQ ID NO: 94670 - DNA, 872 bp, Homo sapiens
gccgtcgtgtcgagcctggtgaacgggtccacgttcgtgctacagaagaagggcatcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacgactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggccttggtggacttctcgccaagggttttcccaattcacgaccagtctccatggcagacacgtctctatacatggtattcaagcaggtaatcttctaccgtgcggtacgtgatgt

SEQ ID NO: 94671 - DNA, 1341 bp, Homo sapiens
cggcgcgccgggcttcgcgctccggtacttcctatttaacagacattgtgtggtgggctggcacaatcgcaatggctgttggccagattggaaacttcctggcttacacggcggtccccacggtcctggtaacccccctgggcgcccttggagtaccgttcggacagatgcccaaatccttgcagagaagtgtgtccatgatgggtgtattgaagtttacaccttagagtcacgtaggcattaaggttctgtgacctaaataccatgtttttcacatgcgacgccttgagaatgtgtgtgtggcacatttttctcgtgaacacatacactgctatcatgtgtggcttggtgtccctttgtgtttcggatggctctgaggcgctgggagggcaagagtgttctcactttgggaaacactcctccagcttctgtgacccgtccccctgaaagataatcaggcagataaacaacctgacctggtgatcttggcacgtggcacattgaatgcacatatactaaaatgttttgctcagttaatttccttagaactgttctcatgcactttgatgattaagtcacttcaccagaaatgttcactgctccacatctgcaggtgttactcactgtaggaaccatgtcagatggtgttctggataaaaagcctgtcttcaacttggaatcccagtccattttagcttcctatctcctgaaggaaaagctcaacatcttgggcaagttggggtgcctgctaagctgtgcaggctccgtcgtgctgattatccactccccaaagtctgagagtgtgacgactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggccttggtggacttctcgccaagggttttcccaattcacgaccagtctccatggcagacacgtctctatacatggtattcaagcaggtaatcttctaccgtgcggtacgtgatgt

SEQ ID NO: 94672 - DNA, 305 bp, Homo sapiens
atgcccattttacaactgaggatctgaggccctaagaagtgggtcacaccagctcagggtcaagtaaattggctgaacctgtgttcttaactctggggtcaaaccaccctgtctgctcccttgagccattttcttggagcctcgtgagggccccagtgtgggtgcacggggttgtcgcccctgcagggcagtcagtgccaggagcttacagggctgatccaactacttggcttcctcatgtgccaggtccttcttctcccaactgcgtacagtggcaacatcttccctatgggctgtggtgacat

SEQ ID NO: 94673 - DNA, 505 bp, Homo sapiens
cccaagtttccgtcttcctaactcccacctgtccttgaggcttcactgaggctctggaaggcaacctctgccctaggttgcacagtccccgtgaagactgccctctgtacctggctgtcttgtttgcttcccaccaggctgtgagtgccaccatggcccaggctgaatcttcaagtctgtgttccccatgcttagcagagtctggcacataccatgtgcccaataggtatttatggaataaatgagtgatggccacatcacagagccagtccaccgcagagccagctacaatctgggtctcctgatgtctaggtcccaactcattccagcagtcctgccaactccttgtggctcagggatgtctcccttgggatgaggggctaacctctcttgagataggtcacttgggcactatccccctccctgaaggactctgttcagcactcgtccttacactggtctgtctaacttcaggtctgatgtctggacaggtgcaggtgatggg

SEQ ID NO: 94674 - DNA, 150 bp, Homo sapiens
tagacacagatgagcacatccttaaacacatccttttaggtagctgaaatgttttaaacaaagacaggcacctggttttctgcaactcaggctttcacagagttttattttttattttatttatttatttttgagacagagttttgcttt

SEQ ID NO: 94675 - DNA, 3273 bp, Homo sapiens
  misc_feature (3272)..(3272): n is a, c, g, or t
atggagaaccaagggacacgcactcagcagataaggcaagtcctgcttctctttgttttgctcggaatgtctcaggcgggctctgaaacctggagcttttctgtggcagaagaaatgcagagcgggagttttgtaggcaatctggcaaaggacctggggctgaaggtgagagaactgtcctcacggggggctcgggtggtctctaatgataagaaacagcgtttgcagctggacataaacactggggatttgctcttaagtgaaacactagacagggaggagctctgcggttccatcgagccttgcgtgctacatttgcaggtgttaatgcaaaaccccacgcagtttttacaaattgagcttcaggtcagggatataaatgatcactctcccatcttctcggaaaaacaaatgctcctagaaatcccagagaacagtcccgttggtgctgtgttcttactagaaagtgcgaaggatttagatgtaggaatcaatgctgtaaaaagctacacaataagccccaactctcattttcacattaaaatgagagtcattccagacaataggaaataccccgagttagttctggacaaggcgctggattatgaagagctcccggagctcagtttcatcctctctgctctggatggtgggtcccctcccaggtctggaactgccttggtcagggtggtggttgtggacattaatgacaactcccctgaatttgagcaggctttttatgaggtgaagattcgggagaatagcatccttggctcgctgattttgattgtctcagcttgggatttagactctggaacaaatggtgaaatatgctataccttttcccatgcctcagaagatattcgcaagacatttgaaattaatcaaaagtctggagaaattactttaagagcacctctggattttgaaacgattgagtcatactcaataatcattcaagccacagatgggggaggactttttggaaaatctacagtcataattcacgtgatagatgtaaatgacaatgctcctgaaatcactgtgtcatcaattaccagtccaatcccagaaaatacgccagagaccgtggttatggtttttagtatccaagatatagactctggggacaacggaagaattgtttgttccattccggaagacctcccattcgtgctaaaatcttcagttgagaattactacacgttggaaacagagagaccactggacagagagagcacagccgagtacaatatcaccatcaccgtcaccgacttggggatacccaggctgaaaaccgagcacaacacaactgtgttggtctctgacgtcaatgacaacgcccccaccttcacccaaacctcctacaccctgttcgtccgcgagaacaacagccccgccctgcacatcggcagtgtcagcgctacagacagagactcaggcaccaacgcccaggtcaactactcgctactcccgccccaggacctgcacctgcccctcgcctccctggtctccatcaacacagacaacggccacctgttcgccctcaggtcgctggactacgaggccctgcaggctttcgacttccgcgtgggcgccacagaccgcggctccccggctttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcaagtgctcctggtggacggcttctcccagccctacctgccgctccctgaggcggcaccggcccaggcccaggccgactcgctcaccgtctacttggtggtggcgttggcctcggtgtcttcgctcttcctcttctcggtgctcctgttcgtggcggtgcggctgtgcaggaggagcagggcggcctcggtgggaagctgctcggtgcctaagggcccctttccagggcatctggtggacgtgagcggcaccgggaccctttcccagagctaccagtacgaggtgtgtctgacgggaggttccgagacaaatgaattcaagttcctaaaaccggttatccctaatatccaggcaaaaggtcttgggaagaatagtgaagaaaactccacctttcgaaatagctttggatttaatttttagtaagaatgctatttacatttgcatgtacttttttagttttatgtaaccatatcaatattatttagtcttaaactagttacgttattatgcaatacgactaattgtatttttaattttttcttttctcccccaattttttttttttttttgagaccgagtctcattctgtcgccctggctggagtgcaatggtgtgatctcagctcactgcaccctccgcctctcgggttcaagcaattctcctgcatcagcctcccgagtagctggcattacaggcgcccaccaccacgctcggctaaattttttttttttttatctttagtagagacggggtttcaccacgttggccgggcaggttttaaactcttgacctcatgttccacccgccacggcctcccaaagtgctgtgattaccggtgtgagccactgcgcccggccttttttttttcttttcttttcttttttttgatacagagtcttagtcacccagactagaggtcagtggcaggatctcagctcactgcaacctctgcctcctgggctcaagagaccagcccacctccgcctccaagtagctgggactacaggcgtgcgccaccatgcccggctacttcttgtattttttgtagagacggatcgtcaccatatttcttaggctggcctttaacttctgagctcaagagatgcactcccctcagcctcccaaagtgctgggattacaggcggccaggcctattttcaattttcaagtattgcatatcattgtgaataacattgtaaatcctttttatattaagtaacaggtagttaatccatttctaatgaataattttaaggttttaatcctttccaagtgtacaataatttactgattattant

SEQ ID NO: 94676 - DNA, 141 bp, Homo sapiens
agattttgttacttcccttgggcaggtggacagagttcaaattactttcataattcagctaaaagaattttatacttcagttgaaattacatgaagacatttttgatctgatatacatatctgcataaatttctattatga

SEQ ID NO: 94677 - DNA, 396 bp, Homo sapiens
gtccagcaggatgtttgtaatgtgaagcaattcttgttaagaatcccactctgcacagtggcccgtgcatgctcatatcagtaatactcctgatcagtatgataaccaaaaatggccccagagatttcagtgcacccgctgagaactgctgacagatcaaatgactctgggacacctggagtcctaagaagtgaaacctccacaatgcaggacagacctggctccctatggtcttccttccttccttcacctccttccccctactttccttacctccctactaaaaagtagttcttttaatgaactgctactgtatgttaggcaatttacattcttgcatattctatacaagtaatgtctctttctcagtcacgttacaactgaggctagattcaa

SEQ ID NO: 94678 - DNA, 223 bp, Homo sapiens
attagctcccaaagttgctgggattacagttgtatgccgctgcactggttagtttttaaaaaaatacattttgcagagatggggatttcgctatgttgcctaggctggtctccaactcctagtctcaaacaatcctctcacctcagcctccggagtagttagaactacaggtgcataccaccatgcctggctaatctttgtttgtgtgtgtgtgtgtgtgttg

SEQ ID NO: 94679 - DNA, 816 bp, Homo sapiens
tttgctcttgtgcccaggctggagtgcaatggtgggatctcggctcaccacaacctccgcccctgggtttaagcggttctcctgcctcagcctcccaaagtgctgtgattacaggcatgagccactggacctggcctgttttttgtttttgttttgaacacacgattttgctttgtcacccaggctggaatgtaatggtctgatcatagtgcattgcagcctcaaactcctgggctcaagcgatcctcctacctcagcctcctgagtatctgggaccacacgtgctcaccaccatgcttggctaattattattattttttgatagagacggggtcttgctatgtttcccaggctggtcttgaacacctggcctcacacaatcctcccacctcagtatctcagagtgctgggattacaggcatgagccactgctcctggccaatatttcatttctttttatggagacgtaataatcagttgtatggaaatagctgattttgttttttattgtatcttttggtgaacatttcaattgtatcgactttttggataaaaacctgaaaatgtttcacctttagaacgtttcattgaatggagatttttttgtggactctggtatttatactagaaccaaatcaaaaccactctggcggctgggcatgcctaggctggtttgagactagcctgtccaacctggtgaaagcccatctctactaaaaatacacaaattagccgagcatggtggtacacacctgtaatcccagctactcaggaggctgaggcaggagaatcgcagaacccgggaggcggagattg

SEQ ID NO: 94680 - DNA, 480 bp, Homo sapiens
ggctgtcaatctagttaaaagaacagctgttcctatgcaagagcaaagtggtcctatttctacctggaggatacacccaatcaatacaaggcactattttgagagctggacctaagcagtgacagaacatcagtgatgaaactttgctgttcctcccactgtagcaaaagaaaataagggtggttggctgtctcagggaaggtcttgcagggtggctgcactttatgaggtcaggaaaatccaaggtctagtcctcaggtttctcaggttcagaaacttgcttcaactggggtgactaggccctaggagactgattcatgctaaccaaactcacaagagactgattcataaaccataacaccaatttattaatttacaatgagaaatgtaattgccaagcagaccagaatacttgtgtcggctggtcagcgaattctcttcctagtaggagaccctaattgggaaaccaaattagcatca

SEQ ID NO: 94681 - DNA, 464 bp, Homo sapiens
atgagggaaaaccccagcgactgaactgttgccatgaaagaaacactaggtaggggagaaggttatttaatttatcattctttcggttgtgttagttctaagtggtgtatgctcagtatgttgctaagagttgagttgcatcatatatagagtcagtgcataagtctcattaagttaatattaaccttgaaaacccaatatataaccaactggtgggcccttagcagctcagaagtcaacaattaacttctttgggttaatacacctttgaggcagtgttgtgcagtggttaacgttcctgagtttgaatcccagctctgcctcttattaaccttggatatgttatttaaacacaccgccttagttcctaaatctgtaaaatggcaatatttacctcatcatggtcctgctttgactaaatgagtcaatacagtataaacaaaatgctgactactttttacata

SEQ ID NO: 94682 - DNA, 610 bp, Homo sapiens
ctgtgactgaaatctgagtagtatgcccagaacttcagaaaagatcaaacagagatagacatataggtaaataaagagaaagtgtaaacgtaagtaattgaaagagcagggaaaatagagctatcaggaaatatttgtgaaggataggttgctagtcttcttcaccaccatttaaacggtatttactgccagaattatctaaaaatggcaatttcataatgctgctactaaacactaagtgttcgtcagattgcacaaagacattagattctgttcacttagtgcctctggaacatcttataataatctaaatgaaaaaaaaagcggtttctctgaaaacttgcctatgatcctccaactctaccttctgaactagtatgaagctcatatttggtataattatgtcttttctgggacctatttgagggtggaatgtgggaggagggtaaggattaaaaacctgactattgggcattatgctgattacctgggtgacaaaattatctgcacaccaaacccccatgacacacaatttgctcatgtaacatgagtaacctttaacctaaaatgaaagttggacagaaaaataaagtgtcttaatatcaaaagt

SEQ ID NO: 94683 - DNA, 429 bp, Homo sapiens
ctaatcccacatgctctcccaagatagcagcctgcccaagtacaccctgggcttcctgttctctccagacatcacagattctctaaatagcatcactgatgacatccacatctttatctgcagcccaaaccccagacataagatataaccacttgaataaacaaatggagatctcaaacttaaaatgggtcaacaggactcctgcggcccaacctgcaccaccattgccatcatgttagtaaactgtgcactcttaaattcttttttcttttttgagtctcactttgtctcccaggctggagtgcagtggtgtgatctcagctcactgaagcctccgcctcctggattcaggcaattttccagccccagcctcccgagtagctgggattacaggtgtgcaccactataactggctaattttttgtattt

SEQ ID NO: 94684 - DNA, 6670 bp, Homo sapiens
  misc_feature (4549)..(4549): n is a, c, g, or t
  misc_feature (4745)..(4745): n is a, c, g, or t
  misc_feature (4753)..(4753): n is a, c, g, or t
  misc_feature (4826)..(4826): n is a, c, g, or t
tgcttttactgtatcataattttgaaagtgcctagtaaggaggggttattagtgtcctgatgtatttcagaagcagcaaactaatcatctttgaatagtggtagatatcttttcaggtagaaaaatttcatcagtaatgccaataagtacaaatataggctctaatgatttcttttaatatttctggaaagtaattagattatatatctgtgatagaatataatactaagtattagactgtagaaggctttgtttcaaggtgtttattcattcatgttactacctacctcaatcataacatcagtaagacctcaatgatctaaatctttgggctttgtaaatcctgaattacttaggtctctgctactggaaagtgaatatcaaaaattgtctatttaagaaaaaaagtagtttttataatctgagttgtatactgcacccatagagatcattttaaatgtagcaatgaatagagattggataaaaacaatgttaaaaattcttttctaattcaagttcaaattttaaaaatttgaaaggcatgttttagtgtataaataatagaaaagttgttgacagttgtttgttttgcagtcagcaagtggtaagaatctttggagagacaacaggagaataaaagccgaaacatgcgtatatacaaaatgaaatatgaatgtgagcttagaggctacacgtggtctctcggatactagaactatctttcttgccttggaccagctaacgtgccttggttgcgccagtgtactgagccctgtggacatcacctcattaaatattcaataaatgttatttttttcctattgcctttctctcttctatatgagaatctgtaagtattcgccgaaggcttttcttttgcttttgtgaataccttcacaccatgttgtattctgtcttggttagttaaaaaaaaaaaaaaagttggccaggcacagtggcttgcacctgtaatcccagcactttgggaggccgaggcaggcggatcacctgaggttgggagttcgagaccaacctgaccaacatggagaaacccatctctactaaaaatacaaaattatccggtcatggtggcacgcgcctatgatcccacctactcgggaggctaaggcaagagaattgcttgaacccgtgaggcagaggttgcagtgaaccgagattgcgccactgcactccagcctgggtgactgagggagactctgtctcaaaataaataaataaataaaaggttaattatatttcttgttatgagacaaatgaagtatttcacattttccattgacgatagcatgtaacgcaggtttttctcttataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggagtcatacatcatttttctacaaaacaaagaagaatcagagcaataaaagaaatggccagggtcttagttcccggaggccaactgatgatttacgtttgggcaatggaacaaaagaaccgtcgctttgagaagcaagacgtgcttgttccatggaacagggccctgtgttcccagctcttctcagagtccagccagtctgggaggaagaggcagtgtggatacccagaaagaggccatccctaccatcctccttgctctgagtgtagctgttctgtttgttttaaagagcagggtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtctagactttgatcaccaagagccattttcaacaaaagagcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagtcgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagggaggttgtgattgattggatccttttagacaactcctccaaaagatgaaccacattcttttctcttggtttgatatggttacctgaatttgcattcagtgttatttgttaatccatttacgctttggtctgcagagactattaattatttggttgtttttgttttcatgtttgaataagcacagattctggcattgaaagcacttgacaaagggtatttgtgcttaaatgttaatataaaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttgaaccatgtgatgagttatcttgttgccaaggccttgcttctacttaaagttttcagaaaactgagtgacagtggagagaaccaagaagttttacaaggactttactaaattataagcaaacttgcttcaaaataagttgacatgtgataataaggttttcaatgtagcccaggaggtttttaaaggcactgttaggctgagcatggtggctcatgcctgtaatcccagcactttgggaggccaaggcagaagcatcacttgaacccaggagttcaagaatagcctgggcaacatagcaagaccccatctctataaaaattagcaagatgtggtggtgcatgcctgtcatccaagctactcaagagactgaggcaggaggatcacgtgagcccaggaattcaaggctgcagtgaactatgattgcatcactgcactgcagcctgggcaacatagcaagactctgtctcaaaataataataataataataataaaggcattgttagcttgtaaggagtggagtatgtaggtagtaggagttatatgcaagtacccaagtggtattcttccaatcttattagaagcatgaatattcaagattgatactactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgactacattttattagttatattaggaatttaggtagaatcaacttctactgattacaggttgaatttctgtcactttgtagagaaacgaatagactggacactgtgtggtcactgtttagatttgcccatgggtctgtttaaatctatgtcatggatcctgagacacaaatataattaagacaggtctagagacaggagaagcagaaataagttgacccaggagtacagtctcaagtagttcattaatgagaaaattgacatctgacaagagtctttttactttatgctggatgaaaatccaaatcttgttttattttttccactaaaagtgactaaaataataacgaatttcatttgttcttgggttcttttttcctttaatgattgtgctataacttaaaataatgatgttacttttgaacaaacttaaagaaatatttttaaagcgtatctgaaaacgattgatgtttataactctcttttggcttcaaaataagattgtgttatcaccattttggtagatgaggttgtctggtgaaaatgatgcatatgagttgtactgttcagtgtacatcctgcagtagtggatgattgaaaacatatataagtggagtataaattaaaaattaatttggtttcttctatttcttttttntttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcnccgtgttngccaggatggtctcgatctcctgacgtcgtgatccacccgcctcggccccccacagtgctgggattacaggcntgagccaccgcgcccggcctgttccttttatttcttaattcaggacactaaaccatgactgcaagggatttccttggtaaaaagaaaagattctcagagtcaaaatgttcttacaactcgggcttgacggcctttgaattatgaatggattgttcctctctctgaagcctattgtcacatgggtttttaatcctggccttgctgctagaaatctgtgcttgaagtcctctctttctgctggtagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcggcctcaacttgcttgatgatagattctactgacctagctggagtaatctgatcacttacttccttattaatactagatcacacagtgtctttcttattccttcttctttacttactggcatcagcacagagtcccactagctgaaatagaagggagagtttgggggtttattggaggagtcttaaaaacttggttggcagctgggtacgatgactcacacctgtactcccagcacttcaggaagctgaggtgggtggatcagctgaggtcaggagtttgagaccagcctgaccaacatggtgaaaccccgtctttattaaatacaaaaaattagccaggttggtggcgcatgcctgtaatcccagctacttgggaggctgaggcaggagaatcgcttgaacctgggaggcggaggttgcagtgagccgagattgtgccattgcactccaacctgggcaacaagagtgaaactccatctccaacaaaacaaaactttgctggcttcctgatgcctcactgtctatttgaggaattccacagaatcttcaaaggatttgggggaaagcgcattaacatggacaaaggatggaatcaaaataatgttatagtgagaatcattcaagcacctatttaaattttttccaattgccagtatagtgatgatatgacaccagcatatcaaagtaactaacaaactagctacacaaacgtcttggagtttggtttcgttctcttttctcatcatagatctccgtgcagaatagtgctaattcttatttctcgtttgcctttctatttccttccaaattctacatgccagtaattcctctgtcttttaagtgaccatcaattcaataggcaaaaatttggagtaatccagagaaaaaaccatccaaatataaaccagctaggaacatgaatgcccctgattattaatggccaaaaaaaaaagcactggtggattttaaattaaattaatacatatatacgagtttggaggagaacagaagttctaactcagtacttgaacttggtgggggagggcacaggttaaatatgagctgtgagcccccagttttggaggaaggaggaaatgggaaccaaccaccagacaagcagctgcagtcta

SEQ ID NO: 94685 - DNA, 6606 bp, Homo sapiens
  misc_feature (4485)..(4485): n is a, c, g, or t
  misc_feature (4681)..(4681): n is a, c, g, or t
  misc_feature (4689)..(4689): n is a, c, g, or t
  misc_feature (4762)..(4762): n is a, c, g, or t
tgcttttactgtatcataattttgaaagtgcctagtaaggaggggttattagtgtcctgatgtatttcagaagcagcaaactaatcatctttgaatagtggtagatatcttttcaggtagaaaaatttcatcagtaatgccaataagtacaaatataggctctaatgatttcttttaatatttctggaaagtaattagattatatatctgtgatagaatataatactaagtattagactgtagaaggctttgtttcaaggtgtttattcattcatgttactacctacctcaatcataacatcagtaagacctcaatgatctaaatctttgggctttgtaaatcctgaattacttaggtctctgctactggaaagtgaatatcaaaaattgtctatttaagaaaaaaagtagtttttataatctgagttgtatactgcacccatagagatcattttaaatgtagcaatgaatagagattggataaaaacaatgttaaaaattcttttctaattcaagttcaaattttaaaaatttgaaaggcatgttttagtgtataaataatagaaaagttgttgacagttgtttgttttgcagtcagcaagtggtaagaatctttggagagacaacaggagaataaaagccgaaacatgcgtatatacaaaatgaaatatgaatgtgagcttagaggctacacgtggtctctcggatactagaactatctttcttgccttggaccagctaacgtgccttggttgcgccagtgtactgagccctgtggacatcacctcattaaatattcaataaatgttatttttttcctattgcctttctctcttctatatgagaatctgtaagtattcgccgaaggcttttcttttgcttttgtgaataccttcacaccatgttgtattctgtcttggttagttaaaaaaaaaaaaaaagttggccaggcacagtggcttgcacctgtaatcccagcactttgggaggccgaggcaggcggatcacctgaggttgggagttcgagaccaacctgaccaacatggagaaacccatctctactaaaaatacaaaattatccggtcatggtggcacgcgcctatgatcccacctactcgggaggctaaggcaagagaattgcttgaacccgtgaggcagaggttgcagtgaaccgagattgcgccactgcactccagcctgggtgactgagggagactctgtctcaaaataaataaataaataaaaggttaattatatttcttgttatgagacaaatgaagtatttcacattttccattgacgatagcatgtaacgcaggtttttctcttataggttgtgggactggaaaatatcttaaagtgaacagccaggtacataccgtgggctgtgactactgtgggccactggtagagattgcccggaatagaggatgtgaagccatgtcatacatcatttttctacaaaacaaagaagaatcagagcaataaaagaaatggccagggtcttagttcccggaggccaactgatgatttacgtttgggcaatggaacaaaagaaccgtcgctttgagaagcaagacgtgcttgttccatggaacagggccctgtgttcccagctcttctcagagtccagccagtctgggaggaagaggcagtgtggatacccagaaagaggccatccctaccatcctccttgctctgagtgtagctgttctgtttgttttaaagagcagggtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtctagactttgatcaccaagagccattttcaacaaaagagcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagtcgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagggaggttgtgattgattggatccttttagacaactcctccaaaagatgaaccacattcttttctcttggtttgatatggttacctgaatttgcattcagtgttatttgttaatccatttacgctttggtctgcagagactattaattatttggttgtttttgttttcatgtttgaataagcacagattctggcattgaaagcacttgacaaagggtatttgtgcttaaatgttaatataaaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttgaaccatgtgatgagttatcttgttgccaaggccttgcttctacttaaagttttcagaaaactgagtgacagtggagagaaccaagaagttttacaaggactttactaaattataagcaaacttgcttcaaaataagttgacatgtgataataaggttttcaatgtagcccaggaggtttttaaaggcactgttaggctgagcatggtggctcatgcctgtaatcccagcactttgggaggccaaggcagaagcatcacttgaacccaggagttcaagaatagcctgggcaacatagcaagaccccatctctataaaaattagcaagatgtggtggtgcatgcctgtcatccaagctactcaagagactgaggcaggaggatcacgtgagcccaggaattcaaggctgcagtgaactatgattgcatcactgcactgcagcctgggcaacatagcaagactctgtctcaaaataataataataataataataaaggcattgttagcttgtaaggagtggagtatgtaggtagtaggagttatatgcaagtacccaagtggtattcttccaatcttattagaagcatgaatattcaagattgatactactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgactacattttattagttatattaggaatttaggtagaatcaacttctactgattacaggttgaatttctgtcactttgtagagaaacgaatagactggacactgtgtggtcactgtttagatttgcccatgggtctgtttaaatctatgtcatggatcctgagacacaaatataattaagacaggtctagagacaggagaagcagaaataagttgacccaggagtacagtctcaagtagttcattaatgagaaaattgacatctgacaagagtctttttactttatgctggatgaaaatccaaatcttgttttattttttccactaaaagtgactaaaataataacgaatttcatttgttcttgggttcttttttcctttaatgattgtgctataacttaaaataatgatgttacttttgaacaaacttaaagaaatatttttaaagcgtatctgaaaacgattgatgtttataactctcttttggcttcaaaataagattgtgttatcaccattttggtagatgaggttgtctggtgaaaatgatgcatatgagttgtactgttcagtgtacatcctgcagtagtggatgattgaaaacatatataagtggagtataaattaaaaattaatttggtttcttctatttcttttttntttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcnccgtgttngccaggatggtctcgatctcctgacgtcgtgatccacccgcctcggccccccacagtgctgggattacaggcntgagccaccgcgcccggcctgttccttttatttcttaattcaggacactaaaccatgactgcaagggatttccttggtaaaaagaaaagattctcagagtcaaaatgttcttacaactcgggcttgacggcctttgaattatgaatggattgttcctctctctgaagcctattgtcacatgggtttttaatcctggccttgctgctagaaatctgtgcttgaagtcctctctttctgctggtagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcggcctcaacttgcttgatgatagattctactgacctagctggagtaatctgatcacttacttccttattaatactagatcacacagtgtctttcttattccttcttctttacttactggcatcagcacagagtcccactagctgaaatagaagggagagtttgggggtttattggaggagtcttaaaaacttggttggcagctgggtacgatgactcacacctgtactcccagcacttcaggaagctgaggtgggtggatcagctgaggtcaggagtttgagaccagcctgaccaacatggtgaaaccccgtctttattaaatacaaaaaattagccaggttggtggcgcatgcctgtaatcccagctacttgggaggctgaggcaggagaatcgcttgaacctgggaggcggaggttgcagtgagccgagattgtgccattgcactccaacctgggcaacaagagtgaaactccatctccaacaaaacaaaactttgctggcttcctgatgcctcactgtctatttgaggaattccacagaatcttcaaaggatttgggggaaagcgcattaacatggacaaaggatggaatcaaaataatgttatagtgagaatcattcaagcacctatttaaattttttccaattgccagtatagtgatgatatgacaccagcatatcaaagtaactaacaaactagctacacaaacgtcttggagtttggtttcgttctcttttctcatcatagatctccgtgcagaatagtgctaattcttatttctcgtttgcctttctatttccttccaaattctacatgccagtaattcctctgtcttttaagtgaccatcaattcaataggcaaaaatttggagtaatccagagaaaaaaccatccaaatataaaccagctaggaacatgaatgcccctgattattaatggccaaaaaaaaaagcactggtggattttaaattaaattaatacatatatacgagtttggaggagaacagaagttctaactcagtacttgaacttggtgggggagggcacaggttaaatatgagctgtgagcccccagttttggaggaaggaggaaatgggaaccaaccaccagacaagcagctgcagtcta

SEQ ID NO: 94686 - DNA, 5852 bp, Homo sapiens
  misc_feature (3731)..(3731): n is a, c, g, or t
  misc_feature (3927)..(3927): n is a, c, g, or t
  misc_feature (3935)..(3935): n is a, c, g, or t
  misc_feature (4008)..(4008): n is a, c, g, or t
gcgtcgtaccaatcagtttacacaagccatcatttccatcctgatttagtcaatcatgtcaggtccgttttggtggaggatgtacacaaaggccctgaagagccactgtctaaaggtaaagtttgaggccaggcacggtggcccaagcctgtaatcccagcactttgggaggccgaggcaggcggatcacctgaggttgggagttcgagaccaacctgaccaacatggagaaacccatctctactaaaaatacaaaattatccggtcatggtggcacgcgcctatgatcccacctactcgggaggctaaggcaagagaattgcttgaacccgtgaggcagaggttgcagtgaaccgagattgcgccactgcactccagcctgggtgactgagggagactctgtctcaaaataaataaataaataaaaggttaattatatttcttgttatgagacaaatgaagtatttcacattttccattgacgatagcatgtaacgcaggtttttctcttataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggagtcatacatcatttttctacaaaacaaagaagaatcagagcaataaaagaaatggccagggtcttagttcccggaggccaactgatgatttacgtttgggcaatggaacaaaagaaccgtcgctttgagaagcaagacgtgcttgttccatggaacagggccctgtgttcccagctcttctcagagtccagccagtctgggaggaagaggcagtgtggatacccagaaagaggccatccctaccatcctccttgctctgagtgtagctgttctgtttgttttaaagagcagggtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtctagactttgatcaccaagagccattttcaacaaaagagcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagtcgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagggaggttgtgattgattggatccttttagacaactcctccaaaagatgaaccacattcttttctcttggtttgatatggttacctgaatttgcattcagtgttatttgttaatccatttacgctttggtctgcagagactattaattatttggttgtttttgttttcatgtttgaataagcacagattctggcattgaaagcacttgacaaagggtatttgtgcttaaatgttaatataaaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttgaaccatgtgatgagttatcttgttgccaaggccttgcttctacttaaagttttcagaaaactgagtgacagtggagagaaccaagaagttttacaaggactttactaaattataagcaaacttgcttcaaaataagttgacatgtgataataaggttttcaatgtagcccaggaggtttttaaaggcactgttaggctgagcatggtggctcatgcctgtaatcccagcactttgggaggccaaggcagaagcatcacttgaacccaggagttcaagaatagcctgggcaacatagcaagaccccatctctataaaaattagcaagatgtggtggtgcatgcctgtcatccaagctactcaagagactgaggcaggaggatcacgtgagcccaggaattcaaggctgcagtgaactatgattgcatcactgcactgcagcctgggcaacatagcaagactctgtctcaaaataataataataataataataaaggcattgttagcttgtaaggagtggagtatgtaggtagtaggagttatatgcaagtacccaagtggtattcttccaatcttattagaagcatgaatattcaagattgatactactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgactacattttattagttatattaggaatttaggtagaatcaacttctactgattacaggttgaatttctgtcactttgtagagaaacgaatagactggacactgtgtggtcactgtttagatttgcccatgggtctgtttaaatctatgtcatggatcctgagacacaaatataattaagacaggtctagagacaggagaagcagaaataagttgacccaggagtacagtctcaagtagttcattaatgagaaaattgacatctgacaagagtctttttactttatgctggatgaaaatccaaatcttgttttattttttccactaaaagtgactaaaataataacgaatttcatttgttcttgggttcttttttcctttaatgattgtgctataacttaaaataatgatgttacttttgaacaaacttaaagaaatatttttaaagcgtatctgaaaacgattgatgtttataactctcttttggcttcaaaataagattgtgttatcaccattttggtagatgaggttgtctggtgaaaatgatgcatatgagttgtactgttcagtgtacatcctgcagtagtggatgattgaaaacatatataagtggagtataaattaaaaattaatttggtttcttctatttcttttttntttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcnccgtgttngccaggatggtctcgatctcctgacgtcgtgatccacccgcctcggccccccacagtgctgggattacaggcntgagccaccgcgcccggcctgttccttttatttcttaattcaggacactaaaccatgactgcaagggatttccttggtaaaaagaaaagattctcagagtcaaaatgttcttacaactcgggcttgacggcctttgaattatgaatggattgttcctctctctgaagcctattgtcacatgggtttttaatcctggccttgctgctagaaatctgtgcttgaagtcctctctttctgctggtagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcggcctcaacttgcttgatgatagattctactgacctagctggagtaatctgatcacttacttccttattaatactagatcacacagtgtctttcttattccttcttctttacttactggcatcagcacagagtcccactagctgaaatagaagggagagtttgggggtttattggaggagtcttaaaaacttggttggcagctgggtacgatgactcacacctgtactcccagcacttcaggaagctgaggtgggtggatcagctgaggtcaggagtttgagaccagcctgaccaacatggtgaaaccccgtctttattaaatacaaaaaattagccaggttggtggcgcatgcctgtaatcccagctacttgggaggctgaggcaggagaatcgcttgaacctgggaggcggaggttgcagtgagccgagattgtgccattgcactccaacctgggcaacaagagtgaaactccatctccaacaaaacaaaactttgctggcttcctgatgcctcactgtctatttgaggaattccacagaatcttcaaaggatttgggggaaagcgcattaacatggacaaaggatggaatcaaaataatgttatagtgagaatcattcaagcacctatttaaattttttccaattgccagtatagtgatgatatgacaccagcatatcaaagtaactaacaaactagctacacaaacgtcttggagtttggtttcgttctcttttctcatcatagatctccgtgcagaatagtgctaattcttatttctcgtttgcctttctatttccttccaaattctacatgccagtaattcctctgtcttttaagtgaccatcaattcaataggcaaaaatttggagtaatccagagaaaaaaccatccaaatataaaccagctaggaacatgaatgcccctgattattaatggccaaaaaaaaaagcactggtggattttaaattaaattaatacatatatacgagtttggaggagaacagaagttctaactcagtacttgaacttggtgggggagggcacaggttaaatatgagctgtgagcccccagttttggaggaaggaggaaatgggaaccaaccaccagacaagcagctgcagtcta

SEQ ID NO: 94687 - DNA, 1593 bp, Homo sapiens
tgcttttactgtatcataattttgaaagtgcctagtaaggaggggttattagtgtcctgatgtatttcagaagcagcaaactaatcatctttgaatagtggtagatatcttttcaggtagaaaaatttcatcagtaatgccaataagtacaaatataggctctaatgatttcttttaatatttctggaaagtaattagattatatatctgtgatagaatataatactaagtattagactgtagaaggctttgtttcaaggtgtttattcattcatgttactacctacctcaatcataacatcagtaagacctcaatgatctaaatctttgggctttgtaaatcctgaattacttaggtctctgctactggaaagtgaatatcaaaaattgtctatttaagaaaaaaagtagtttttataatctgagttgtatactgcacccatagagatcattttaaatgtagcaatgaatagagattggataaaaacaatgttaaaaattcttttctaattcaagttcaaattttaaaaatttgaaaggcatgttttagtgtataaataatagaaaagttgttgacagttgtttgttttgcagtcagcaagtggtaagaatctttggagagacaacaggagaataaaagccgaaacatgcgtatatacaaaatgaaatatgaatgtgagcttagaggctacacgtggtctctcggatactagaactatctttcttgccttggaccagctaacgtgccttggttgcgccagtgtactgagccctgtggacatcacctcattaaatattcaataaatgttatttttttcctattgcctttctctcttctatatgagaatctgtaagtattcgccgaaggcttttcttttgcttttgtgaataccttcacaccatgttgtattctgtcttggttagttaaaaaaaaaaaaaaagttggccaggcacagtggcttgcacctgtaatcccagcactttgggaggccgaggcaggcggatcacctgaggttgggagttcgagaccaacctgaccaacatggagaaacccatctctactaaaaatacaaaattatccggtcatggtggcacgcgcctatgatcccacctactcgggaggctaaggcaagagaattgcttgaacccgtgaggcagaggttgcagtgaaccgagattgcgccactgcactccagcctgggtgactgagggagactctgtctcaaaataaataaataaataaaaggttaattatatttcttgttatgagacaaatgaagtatttcacattttccattgacgatagcatgtaacgcaggtttttctcttataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggaggtaaggcagccagatcacacattcaccctttgccatgagaataattgacccggtttagtccgttctcatgagtcaacatccgttct

SEQ ID NO: 94688 - DNA, 5161 bp, Homo sapiens
  misc_feature (3040)..(3040): n is a, c, g, or t
  misc_feature (3236)..(3236): n is a, c, g, or t
  misc_feature (3244)..(3244): n is a, c, g, or t
  misc_feature (3317)..(3317): n is a, c, g, or t
tgatacatcatatgtacgacacacagaagattcaaatgaataccatcctgggtccggctctccatgccgggaggcaactgatgctaatgtctggtcatgtggcatcaactgaaccgtgggtgagatagtcaagacgtgcttgttccatggaacagggccctgtgttcccagctcttctcagagtccagccagtctgggaggaagaggcagtgtggatacccagaaagaggccatccctaccatcctccttgctctgagtgtagctgttctgtttgttttaaagagcagggtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtctagactttgatcaccaagagccattttcaacaaaagagcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagtcgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagggaggttgtgattgattggatccttttagacaactcctccaaaagatgaaccacattcttttctcttggtttgatatggttacctgaatttgcattcagtgttatttgttaatccatttacgctttggtctgcagagactattaattatttggttgtttttgttttcatgtttgaataagcacagattctggcattgaaagcacttgacaaagggtatttgtgcttaaatgttaatataaaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttgaaccatgtgatgagttatcttgttgccaaggccttgcttctacttaaagttttcagaaaactgagtgacagtggagagaaccaagaagttttacaaggactttactaaattataagcaaacttgcttcaaaataagttgacatgtgataataaggttttcaatgtagcccaggaggtttttaaaggcactgttaggctgagcatggtggctcatgcctgtaatcccagcactttgggaggccaaggcagaagcatcacttgaacccaggagttcaagaatagcctgggcaacatagcaagaccccatctctataaaaattagcaagatgtggtggtgcatgcctgtcatccaagctactcaagagactgaggcaggaggatcacgtgagcccaggaattcaaggctgcagtgaactatgattgcatcactgcactgcagcctgggcaacatagcaagactctgtctcaaaataataataataataataataaaggcattgttagcttgtaaggagtggagtatgtaggtagtaggagttatatgcaagtacccaagtggtattcttccaatcttattagaagcatgaatattcaagattgatactactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgactacattttattagttatattaggaatttaggtagaatcaacttctactgattacaggttgaatttctgtcactttgtagagaaacgaatagactggacactgtgtggtcactgtttagatttgcccatgggtctgtttaaatctatgtcatggatcctgagacacaaatataattaagacaggtctagagacaggagaagcagaaataagttgacccaggagtacagtctcaagtagttcattaatgagaaaattgacatctgacaagagtctttttactttatgctggatgaaaatccaaatcttgttttattttttccactaaaagtgactaaaataataacgaatttcatttgttcttgggttcttttttcctttaatgattgtgctataacttaaaataatgatgttacttttgaacaaacttaaagaaatatttttaaagcgtatctgaaaacgattgatgtttataactctcttttggcttcaaaataagattgtgttatcaccattttggtagatgaggttgtctggtgaaaatgatgcatatgagttgtactgttcagtgtacatcctgcagtagtggatgattgaaaacatatataagtggagtataaattaaaaattaatttggtttcttctatttcttttttntttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcnccgtgttngccaggatggtctcgatctcctgacgtcgtgatccacccgcctcggccccccacagtgctgggattacaggcntgagccaccgcgcccggcctgttccttttatttcttaattcaggacactaaaccatgactgcaagggatttccttggtaaaaagaaaagattctcagagtcaaaatgttcttacaactcgggcttgacggcctttgaattatgaatggattgttcctctctctgaagcctattgtcacatgggtttttaatcctggccttgctgctagaaatctgtgcttgaagtcctctctttctgctggtagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcggcctcaacttgcttgatgatagattctactgacctagctggagtaatctgatcacttacttccttattaatactagatcacacagtgtctttcttattccttcttctttacttactggcatcagcacagagtcccactagctgaaatagaagggagagtttgggggtttattggaggagtcttaaaaacttggttggcagctgggtacgatgactcacacctgtactcccagcacttcaggaagctgaggtgggtggatcagctgaggtcaggagtttgagaccagcctgaccaacatggtgaaaccccgtctttattaaatacaaaaaattagccaggttggtggcgcatgcctgtaatcccagctacttgggaggctgaggcaggagaatcgcttgaacctgggaggcggaggttgcagtgagccgagattgtgccattgcactccaacctgggcaacaagagtgaaactccatctccaacaaaacaaaactttgctggcttcctgatgcctcactgtctatttgaggaattccacagaatcttcaaaggatttgggggaaagcgcattaacatggacaaaggatggaatcaaaataatgttatagtgagaatcattcaagcacctatttaaattttttccaattgccagtatagtgatgatatgacaccagcatatcaaagtaactaacaaactagctacacaaacgtcttggagtttggtttcgttctcttttctcatcatagatctccgtgcagaatagtgctaattcttatttctcgtttgcctttctatttccttccaaattctacatgccagtaattcctctgtcttttaagtgaccatcaattcaataggcaaaaatttggagtaatccagagaaaaaaccatccaaatataaaccagctaggaacatgaatgcccctgattattaatggccaaaaaaaaaagcactggtggattttaaattaaattaatacatatatacgagtttggaggagaacagaagttctaactcagtacttgaacttggtgggggagggcacaggttaaatatgagctgtgagcccccagttttggaggaaggaggaaatgggaaccaaccaccagacaagcagctgcagtcta

SEQ ID NO: 94689 - DNA, 268 bp, Homo sapiens
cagcgcttggcccagagagctggccttctgagcagcatgtcagagctgataaagatgctggcgcctggcggccaccaaggccaccctggacaaccattctgccttctcattagcattgtgccactgttacctcacttgacaataacaactgccgtggaggatctgacaagcacaggtcgccccgaaggtgaaaggagaaaaggatctgaagacaaatcataaaaattgtttcaccctgtctggaaccatcacaagctgacccggtgct

SEQ ID NO: 94690 - DNA, 472 bp, Homo sapiens
caattcttttccctttcagatatcaagagtctttttctctaataatctcaaaatctgtaaagagttctaaaatctagccatttttatgtgcttaatacagatttagtttcagattccattgagcttgcaggggacttacaggtagataatttagcccattttacagtggaggcagtgaagggctaggaaatgtaaataactttcccaaatacacatggtgacagtgctagaacttaatcactcttttaaatattaagtccactgctatttgtattacatctcttttagcattttgagcttcttggtaattgttgaatgataagttttgtgttttcttaacagaatttgaggtccctgtaagtgaaagggtatttcgggttacagctgagaaatggtgcagactcctcagactgctctggctacgtaattttcagggcccagtgcaaaataaaagtgtgagatctccttttca

SEQ ID NO: 94691 - DNA, 201 bp, Homo sapiens
ccagtagccttggaatatctggtttccctgatggttatatttcttatcataattgatatcaatatcttataagggccaggcatggtggctcatgcctgtgatcccagcaccttgagagcccgaggcgggctgatcgcttgagcccagaagtttgagaccagcctgggcaacatggtgaaaccccatctctactaaaaatac

SEQ ID NO: 94692 - DNA, 365 bp, Homo sapiens
gccaggcagtggaggaaggtgcttgcgggagctgcgaacacacaacagtgtgtcggcatacttatagacaattactgaacaaattatatgctcagctagtatgcttcaatccaacattaggaaatcgtttcaagaaactgttttaaacatttttatagcaatgtatctttaatacttttctcagcatggggcagaagagaactttacatatttacttgcatgtactttacatctttttgtctgctgtacagatctgtaggcctattgtttttccttccactaattttgaagtgtctcagtttaaagcatatttgttggaattatattatgtatccatggttgtcctggataccttttctttgccc

SEQ ID NO: 94693 - DNA, 807 bp, Homo sapiens
agcggagtaattaaaagtgtagtactgacatcaatatacactaatagacaatgtaacagaattgagagtcagaaatagccctgtgatatatgtgactgattttaactaaagttacaaatgtggtttaatagagaaagcatagtagtttcaagaaatggtggtaaaactattggaaatccttatgcaaaaacaaaccaaatttccacctacactgagccacatataagaattaatacaaaatggattacagacctaagtgtaaaactaaaactctaaactgtgtaaaaaaaaaaaagagagaaaaatctgtgatcatggattgcctataacaaaagaacaaactgaaatggccttgttgcctggggtggcacccgaggttcttggtctcacgctgaggaaatcaaggacgctgacacaccaagggtgtgaggctagagcagaagtttaataggcaaaagaaagagactagctctctcctgcagagagaggtcctgaaaagagttcccattccacagtgaaatgcaagcatttttataaatgagctaatgggaagggggtagcttatctacacatagggagcaaaaaaccagttaggaccaggtgttgccatctgcacagagcgtgaatctctggcatcccccaccccaacctttcattatgcaggcaggtccttggcctgagctactccacattgcttatctctttcctattgtgcctgtgctaaataaggggaggtggagccaccatggtggacatgcctggccccaggtacccctttctctccgtgcagctgcaggcaaccccaac

SEQ ID NO: 94694 - DNA, 448 bp, Homo sapiens
ggggagggaggggctggcagcctatcgggtaggctcacctggtagcagggtgaccttgccctctggtctggccgcagttggggaattgagcctttttgcctgcaagctttctcctcctcctcacccatgccactgaggaaatggtaggaaatgattctgggaagttcttctcaaatttcattgtcattcttggcatggatggtcagaaccaggaagagacttgtcttgtaacagctttttgaggggatccacacatattcatcagaagaaagataaatttctgccaggcacagtggctcacacctataatcctagcattttgggaggctgaggtggggagattgcttgagaccagcctgggcaacatagtgaaaccctgtctctacaaaaattagccgggcgtggtggcacatgcctgtagtcccagctactctggaggctgaggtgg

SEQ ID NO: 94695 - DNA, 281 bp, Homo sapiens
gtgtgggcttagaggactggtagcctgggagagagcaatgagcctccatggaggggcctgtacaccgggaggtgctgggcaactcccatggctcatctcaaccacagtcctcggcggtttgttttctgcattagcttctcatgccagaacaccctcttatttgtttacctgcttagtgttggcctcttgcaggtagagtggccactccttggagggcaaggcctcttgtacttgttcgtcatcatatcctacgccgcagcggtgcctgtgcatgaaactga

SEQ ID NO: 94696 - DNA, 277 bp, Homo sapiens
aacgtccccccgtggctcctgggctaacggtgcacttctccgtcctgcttcactgccttatggcacgtgtccatttccccaaccaccggtgggccccgggtggcttggccggcctggtgtcccgtgcccagcatgggctctggcccaagttagcacttgctgcctaagtgcctctgccttttactcacctccatctggagcgggctcagtggggttcctgctggggctctacgggggcatccagactttgccctctgaccagccccactgtcctgtc

SEQ ID NO: 94697 - DNA, 666 bp, Homo sapiens
tacatctttaagtaatgtgcttataacttacaacattttttgatttatgttgacaacgcagtgggctccatgccatctctccagaaggctccccccttcctgacttcacctggagttttttcttctgccgcaggttcaagagccatattcgaatactctctgccttggaatagtgattctcacactggagctggcatcagaatcacctggggggcttgctgaagcacaggcccggcccggcactttctcatacagtgcgtctggagggaggcctgagcataagcgtttttgttttgttttgagatggagtcttgctctggtcgcccaggctggaatgcagtggtgtgatctcagctcactgcaacctctgcctcccgggttcaagtcattctcctgcctcagccttccaagtagctgggactacaggcatgcgccaccacgcccggctaatttttgtgtttttagtagagatggggttttgccatgttggccaggatagtcttgaactcctgacctcaagtgatctgcccacctcggcctcctaaagtgctgggattacaggcgtgagccaccgctccgggcagtgcataaatgtttttaatatgttctctgtggcgccgatgctactggtcgcaggatcccactttgtggagcactcccttagcg

SEQ ID NO: 94698 - DNA, 391 bp, Homo sapiens
ttgtccataatgtacagatggatgtagacaactgccctcagggctgtccgggggcaggaccaagcccagcaaccacacctcctgacacagccaggttctcccccaacggcggagctgacaggactgttcatggttcattgagtggacccagcaatacctcatcgataatccacagtcgagagaagaggggcggtcagagaccggccagccctcccttctgattgggagaggcctctgcaggcactgacaggctccagagagtgctgtggggggcagtcagtgtccatagtcccctggaatcttctctgggctgttttctctgacttttcacctgaaattaactgtacatagctgggctaggaactctctaaatctgaaagcatgtggctta

SEQ ID NO: 94699 - DNA, 570 bp, Homo sapiens
gtgctttcaaattcatttttagcagggcccacatggatggtaatatcatcattagtgatgcccaagtcccatgtaatcaaccacagaaggatattgctctgaaaacagaaggaacattggcaatcagagcttctgcagccgaaccatgcaggagagtgcctgctccgtctctgccagctgttggtaaggcactgtgagtgagatgagttgccttccctaaggcagaagccatgatttacatctggcaatcaactgtatcaatggtaggcagttagacagctgcagccttttgcagtgggctgtgctcaccctggatggtctttgtggttccagctattgtgtttcaggccccatttgtctctgccagctctgctattctcttttttaaagctaagccttggtttcacgaaacaattactgaattgaagcacttcagtaaaggaaaacgtcaccccagtcattcattgacaactcaaaaccagaagagaacttcgaagtttggagaatgttggttggacattctcagccacttatgtaccattattatgatttttacaatatccatgtact

SEQ ID NO: 94700 - DNA, 304 bp, Homo sapiens
ttaatatgctggtaatatggtagactatatttttttgaatattgaagcagccttgcataaactcttaggataaattctacttggtcgtgatcattctctatattttgctggattatatttgctaatatttgttggggatttttatgtctgtattcatgagggatattgatttgtagtttccttttctgtactatctttgttttggtatcagagtcataggttttctcatgaaataagttggaaagtgttttctcctcttccgttttctgaaagagattttgtagagtcaaggctatttcttctt

SEQ ID NO: 94701 - DNA, 356 bp, Homo sapiens
attgcattttctggaaaaaggcaaagaaattcaaacaagcctgtggtaaattatccagtaaaaataaaatgaaaagagtatagaactgcatcaatttcatagaaaggagaaacaaaatattaaatattaatccaaaagaaagcaaaagaggacacaggaacaaatttgaaacaagaaggataaacagcaaatcctaatagacttaacccccaaatgtcagtattaatattatatataaatgaatttaacgcttacctcaaatttcaaaaacagtaatgtcagaggtgtttgaaccacagcaactccatcttgagtaggggctggataaaatgaggctgagacctactgggctgcat

SEQ ID NO: 94702 - DNA, 440 bp, Homo sapiens
aaacatggtaacatctttcaaaaaccttgtcttgcttcaaccttctagccatataatttagcatccctgtactctttcactaagctttttaataacattgatactctgtgctgccacctcctattcgtctggtgcccaacttttgtgtttagtcctcatttcatgtaattttctgttatatgagacaccactgacacctctttctctcacttaccaaacaaaaaacaaactaaaatctcaccaagtcatcagaaccttctaattgtcatctactcttttcctatctttgacctctctttggcatctgatctattgacgtgtcccacagtgctccacacgtcctggttctacactctgtcctggctctctacctagccctctcttcagtgatttcttttccgccacacactgactctacataggatagcccacttcagtga

SEQ ID NO: 94703 - DNA, 359 bp, Homo sapiens
agaaggaaaaggtaagtaccctgaaggattgaaaggattaaatgaacattgagggatgagcaatttctgttcttccctggctccagcattaccaaagcacacagtaagaggactgacatcggcctccgacccagtgaggattactttcggggtggagggggaactgctaaacctcgaatctccgggactggccctggcgcgtttccagtcccagcagaaagggcaatccccatccagaccacactcctagtcctccttattcccacacagcccgtatcttgaccacccccagctccgccctctctcctcccacctccttttcccgctcccccgccccatttccttcttctccgcccacc

SEQ ID NO: 94704 - DNA, 387 bp, Homo sapiens
ccatgttgcccaggctggtctcgaactcctgacctcaggtgatccgcccatctcagccttccaaaatgctgggattacaggcgtgagccaccacacccggctgacatgggtattgtttgcctggggtctagtacaaggactgcagtgataataatgcctgcctacaatggagtgtcctaggcattgctcaaggtaatttttgcacagcatgctgacaaccttgaaacatcacacaggcataaaatctttttattattgatattcatgcagtcaagaatttgtcttaaaaccaaagagcaaaaatatcaattgtaaatatcaacagagattacaatagtcatcagtaatagctttcttactataagaatgttgtagtataattaaaaa

SEQ ID NO: 94705 - DNA, 335 bp, Homo sapiens
cattttgacagtttctttttaagttacatatatcttgccatgacccaaaatcccactcctcaatatttaccttagagaaatgaaaacagatgttcatacaacatatgttcacacacacacatatgttcacacgtgcccaaactgccaaaaactagaaccaacccctccatcaatgagtgaatagaaaaactgtttactgtggagtactattcagcaataaaaggaacaaactattaacacacatataaacttgggtgaatttcaaaggcattatgctgagtgaagaaaccagtctcaaaaattgatgattccaattacctgacattctagaaaga

SEQ ID NO: 94706 - DNA, 670 bp, Homo sapiens
agcacaaacaactgcatacggcccgaggggaggctgaaaaggacttgtgtgtggtggttttattgcctgtcatcactttgctggcctcctcccgactggagcctggaggttcacagtggatttctttctgccgaagacaccaaggcactgaggaaggatcccttctccttctgttgactctttctatttttatggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataacaatggaggcaagctcttctggaatcactaatggaaaaaccaaagtcttccacccagtggccaaggatgtcaatattctttttgatgaattagaagctgtcagcagtccttgcaaagatgacgattctcttcttcaccctggaaacctgactagtacttcagatgatgccagcagattggaagccgggggagagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattg

SEQ ID NO: 94707 - DNA, 818 bp, Homo sapiens
agccctgtcagaggcagtatgtctcttttagccaacttttagtttttcatttttagatttctactatcttttcatgtcagccacagggaatgtgaaagctaagtaggtctgatcattataaacaaaatctacagaaaacaatagcaaagactcaggaaaatagatgcatttatttaggccagcttaatagcttagcatcaaggaatcttttgcctactgcctcttggttatcactgaccatttataaacatgaggccaggtgccgtggctcacgcctgtaatcccagcactttgggaggctgatgcaggtggatcacttgaggtcaggagttcgagaccagcctggccaacatgatgaaaccccatctctactaacaatacaaaaattagttgggtgcagtggcaggcacctgtaatcctagctacttgggaggcagagacaggagaattgcttgaacccaggaggcgaaggttgcagtgagtggagatcgtgccactgcactccagcctgggcgaccaagtgagagtccgtctcaaacaaaacaagcaaactaacaaaaagatgggatgaacaacctgatggttctggagcctttgccacataggtctcacctaaggtcaggccctatgagtgagacagcctgcttatatattgccttctgccttccagaatatttttattagtctttcaagagagctaagcatcaaataatttctcaaaaaattgtcaatgactcattgaaagttcatagaagcacaacagatccaaatttctcctgtggataatgtattgaaaagtggcaaaaggaaagagagag

SEQ ID NO: 94708 - DNA, 681 bp, Homo sapiens
aaaagggagccaccacccctgccagcaaaatgtcttctgcaaggagaccctcttccaattgttcctttccagagcatagctctgactggtagagcctccgtcacagtgcgcaccctgactgcaaaacagactaaatgaagacttggccatgcaagcaaggggaggtgagacctgatactgccagagaaggaatagggcactgtcaactcgctaactgggtcctagtattggctatgtaaccctagacaagttactttacatttctagacctcagttcagcagttggaacacgtggactttggattttcttcttcctggaacttcctttatgcactcatgtttgttactcacccatgtatttatccattgtccatgtctgcttgtcagttttagttacctcctacccccacctgtccaaggtgctcttgtcctcagaagatcccactggcatgaataagacagacttggaaacttttatcctagataaaactggtctggaacacataaaaagtatttccccaacaattttgattcacttcaattcctgaaatctaacttctgactttcaaagaaaattccactttggcagctgtacaggtaccaacaacagtttacccttacctggaagaagagccttggaggagaaaacacaccatgtcggtatgggtgtgacaaagtcta

SEQ ID NO: 94709 - DNA, 542 bp, Homo sapiens
tagagacggggtttctccatgttggtcaggctgttctcgaactcccaacctcaggtgatctgcctgccttggcctcccaaagtgctgggattacaggtgtgagccacagtgcctggcctaatttttgtatttttagtagagatgaggttttacgatgttggccaggctggtcttgaattcttgacctcaaatgatccactcacctcggcctcccaaagtgctgggattacagacgtgagccaccgcacctggccgggatttacttctatatgtaaaaaaacccagacctgcacaaaggattgggaagattggctttagatttatcaatagcagtgctgaaagctagaagacctcaaattctgagggaaattatttccagcctttaatttagcgttcatccaaattattgacaagacgtgtacataaaataaaaacctttttgggatctgtcatgtttgaattttccattcacacaccctttcttaggaagctatggagcactgtgagccactaaaacaggaagttgagaaagagggaagtac

SEQ ID NO: 94710 - DNA, 470 bp, Homo sapiens
tgttaatcctgctctcaagatgtaagtaaggtgtgtttcagacattattaaaatactgaaatagtggtatttgtaccaaaacactagtatctcattacttaccatgatatataacactgtataactgaatagtggaataccaaaattgaaattgcacactgcatctaatcctgtatgcatccaagtatattcttctgtgcctgtactgtctgcctttttcatgttttggacaaaactgtcatcctttgtgtacctcctctctgtgtccacgttcctattctcctccctcagtgcctttattctctcccttcccattgcttcctttgtatctgcttacacatgttcatatgtttctcttattttggaaaagaaagaaaaaggtcattcatttaatcttaacttgactattagtttcgttttctttccttccttccttccttccttctttctttcctttttttttttttttt

SEQ ID NO: 94711 - DNA, 272 bp, Homo sapiens
cagcttcctcacctgtaagatgcaagcaataagacgaattttagagggagttattaaatgatataatatatatacactgtagagcagagaacttgacacatagtcaaatgttcactaagtgtttatctcttccttttaaagtctggggtaaggctttttgactttaggccagagggagccgtagaaggttgtggaggatgaaattgataagattatatccatttgctgttatgtttgggtgttggtgttgtgtggaggatactggtccaaga

SEQ ID NO: 94712 - DNA, 120 bp, Homo sapiens
acatagggtcaggaccgagtttcctctcacaagactcctagccccaccttgaaatcaccggacgcgcttcgttgtccaggagccttctcgaagcggcgggacgtctccggaggttgggtg

SEQ ID NO: 94713 - DNA, 500 bp, Homo sapiens
tcttaagtattttactctttttggtactactgtaagtagatctttctcagtttcctttttggattgttcaatgttggcatataaaagtgtaagtgccaggcacagtgtcacatgcctatagttccagctactcaggaggctgagacaggaggattgcttgggcccaggagtttgagatttcagcatgctatgattgctcctgtgaatagccactgcactccagcctgggcaacataacaagacctcatttcgtaaaaaacacataatactgatttttgtgcattggttttgtatcctttgctgaatttgtttattctaacagttttttggggggtgtgtgggatctaggattttctagatacaatcatgtcatttgctaacagattttacttcttccaaatttggatgtcttttatttcttgttcttgcctaattgctgtacctagaacttcaaatactgtgttgaaggaaggaggcaaaaaaaaaaaaaaaaaaaaaaa

SEQ ID NO: 94714 - DNA, 298 bp, Homo sapiens
attggccagctgtgtgggcatatgaatgttacatactaacagtggtaaaatgagaattttaattgcaggggtctgcaaaggatattgcttgtgggccaagtgtgagtgctgcctgtttttgtaaataatgttttattgaaatatagccatgcccattcctttacacatcgcctatgtcctctttctccctaccacaactgagttgagccatgcaacgctgagaccttacatggccacgaaatctaaaatgtttttttctagctctgtacaaaaaagtgtgccaatctctattattatg

SEQ ID NO: 94715 - DNA, 948 bp, Homo sapiens
tcacttacttggaactttttatgcccctcttatgccaaataaacatgccattactttgtggtttagattgtgctgtgaattgtttgagaacccatctttctgatagcatatatggatctgttaaaatatcatcagtttgttggcttaatatcaatttattgaaaacagtcaaattcagatactcaaccagtggttaatttctagtccacggttcattctttgtaaatggatagtgaactaccttaccaggaatgtgacctgtcacccagtttttcccccgctacaaagctggaagacagagaaacttgaaatgttatcattattgttattgttgtagtttgccttcatgctttctatttaaatgctaatttagaaatataatggaaatgttggatatactattcaatgtattcagtgtgggatgcctttaaagtacaaacgcgttccttttctcctagtcttaagtaaaaattggtaagagtatcaagagaaaataatagcatatataatagttcatgttagagcttctgtcagtgttaaagtactttttaacttttttcatatttatatgtattatactgtcaaaatagcactttttcagggactgtgtaccaacatgattaacatgatgttttacccccaaaactgtgaatatgcaggaatatgttagtatggtggtagtttctgtaggtaagcagtaagaaaaataggtgaatacttattgaatatagtattaccttttcatgtaatagtacttagactaaggagaatgtcaaataattagtttattaaaatacttagttacagtttattatatactgtttttatacatgtgagtttagattatacctttggatatagttagtgattttaaatgagacatcttttagtgcccagctaactcagtcagtagagcacgagacccttaaataagacttctttttgtag

SEQ ID NO: 94716 - DNA, 765 bp, Homo sapiens
aggcttaagtaatcctcccacctcagcctcctgggtagctgagatcacaggcgcgcgccaccacaccaagctaattttttgatcgtctgtagagacgtgttctcacaatatggcccaggctggtgttgaactctcggagctcttagatgttgattcagactccttcatagtataataggcttaaaatggaaagactgtgcgtacaggaatttatcctaaggaagtaatgtgtcagatttgcgtatataaatttaatatcagttattaagaattttttttaaaattaaatattcaagttttgggaatctgctaattctgttgtgaaagtggaaatctatacagccacttaaaacagtatcgtaggtgaagagtatgatgggaaaatggtaacggtatacagttttaactggaaaggaaaatgttgtaaaactgctaatgtcgtttgattgttttttaaacgacaatgtaaacatgaaaatagagatataccccaaaatgtttgctcagatgttggcattgtttactccctgatgtttttctgaatttaccacgagaaataacatcaacttttgtaatgagagaaaaaaatgaaaaacatattttgtaaatactgtaactgcttaaaatattagagtcctctgtatttttaagcgaaattggcatagacaaactagctgcttcaagtctgaagtgaaaagtactgagaagtgacagaaagtagtgcttgtgtaacattttggatattgggtataagcaaacacagga

SEQ ID NO: 94717 - DNA, 1064 bp, Homo sapiens
tagatgcccagtagtggagtggctgaatcaaatggtatatctatttttggctctttgagaaatctccatactgttttgcacagaggttgtactaatttacatgcccaccagcactgtttaagagttcactttctccatatcctcaccaacatctgttagtttttgtctttttaataatagccattctaacatttgttttcttagtattgagttgtttcatttccctatatatttttggatattaaccccttatcatatgcatggtttgcaaatattttctcccattttgcaggttgtctcttcactctgttgattatttcttttgctgtgtagaagctttttagtttaagtcccatgcatctgtttttggttttgtttttgtttttcgattggggggatggagtttcgctcttgttgccaggctagagtgcaatggcacgatcttggctcacttcaacctctgcctcctgggttcaagagagtctcctgcctcagcctcctgggtagctgggattacaggcgcgcatccccacgtccagctaatttctttgtatttttagtaaagacgaggtttcaccatgttggccaggctggtcttgaactcctgacctcaggtgatccacctgcctcggtctcccacagtgctgagattataggcgtgagcctgtttttgttttaaaatccttaaggagatgtacacgaccccacaggacctgaccctggctcccggccagcctcacctcccatggctttcctgcccctgtattacctcacttccttcccctttagccatccttcgggcctcagttcaagttcacatcttcaggatggtagtctacgaccccttataccagttgagaccatcttttaggcattcctacctcaccacttgattttctttcagggtatttagtacatttgctgttgtaagataacgtgggccttttcatcaatggcagtctcccgtgctagaatacataatccagtactgcaggacatagctatatattgcttatccatgaattcccagtggcaaagccccagtagaatttcaatacatatat

SEQ ID NO: 94718 - DNA, 351 bp, Homo sapiens
attccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttaga

SEQ ID NO: 94719 - DNA, 227 bp, Homo sapiens
tgattccccagggggtgcaaacaatcttcatcacccccccaacactaagaaaaaaaatgtcttcctgtcacgtggctgtcacttcctgtcccactgtggttcctgggatgtttgttgttggttgccatggtgatgtctgccgtgggcactacccctggttcttgtggggaaggagctacccctccccaccaggctgggggggtacttgggggacttgactagggggt

SEQ ID NO: 94720 - DNA, 742 bp, Homo sapiens
ggtaaccaccattctactatctgtttctttgagctcaattgttttaaattctatacataaatgagaacatgtagtattagtttttccttgcctggcttattttacttagcataatgctctccaggttcatctattttgccacaaatgacagaattttcttcctttttaagactgtgtagtatgccaccatgtatacgtacaatattgtacagcattgtaagtcatgctgcagtgaacatgggagtgcagatatctctttgacatactgatttcaaattctttggatacatacacagaagtggaattgctggattctattgtaattctatttttagtttttgagtaatctccatatagttttttgttatccccatgtcatttttcacagaaataggaaaaaatccaaaaattcatatggaaccacacacacacacacacacacacaaaagcaaggcaatattgagcaaaaagaacaaatctgaagacaccatactacctgattccaaactataatataaatctatagtaattaaaacagcatgggactggcataaaaatagacacatttgccaatggaatagaagaaagaaccaagaaatgaactcaaacatttacagtcaattgatttttgatgaaagtgcaagaatacaatgggaagaagaaagtctcttcaataaaaagtattgacaaacatgaagaaaaagaatgacattggatccttatctcactctttatagaataa

SEQ ID NO: 94721 - DNA, 591 bp, Homo sapiens
agcgaaatctgcaagcaggccctgagcaccaacgccagccgacctctgagaaagcagcttgggcagcataagctttgcaaaggaaaataaaatcctcagcatggagtctcaaacaagaaaaatagtgagatatttaaacctgaccatttctttttaaagacttgggtgttcttcagaaagggaatttccctcccaccccagaagggtccaaagtgttactcatattatttacagagctttgaagtgtgcctccaaagtttgagttcagctctgaagaatgtgaaggtcaaatcattttccctttctgatgaaggaaggctgtgaatttaataccacaatttattcaaaacaaggaaatacactgaggcactctccactattaatgcacaacagtagacggttggaaccatctcatactccaaagagtttatatggtttggccaacagtggtgatacatttaatgagcctctggttaatccattcctaccagactcagcacctgtaaaatgcaagacactttgcttctaataataggaattgagttaatttatttaaacaatgttagagtcatcattttctaaaagtaaaat

SEQ ID NO: 94722 - DNA, 455 bp, Homo sapiens
ctttacaataattattatagccaaagccaccatatattctgcatttcccaggatggtgtcagttttgaatgttgtttctttcaggcaggcatggtgaattttggttcagaaaacaggatcactctgtcacgctcttgagggtgaactgttggagagtcactgtggtgatcaaccaatgggtactccctagttcctggaactgagaacttcagtctggatacttctctataaatggtttcggtagactctgccactttccccggggatctgaaagagttctccaagaagcccccacttctcaggcggcaacagggcaggtacctgggcggtagcccttatgctactgttcataaatcaatctgagttttatgggtgctttttctgaggaaggagagatttaaagttatgtagcggcaacaaagctttctaataatatttttggcaggctgctaaag

SEQ ID NO: 94723 - DNA, 364 bp, Homo sapiens
attacttcgctttgttctgcttgtgacctagagtgaattttattcatagcaaaattagaccttactagcttcttatacctgaatggcctagaggtagagaaatttccagaacagccttattagagagtggggtgcatgacaagaccataatctaaagccagttttcagttttattatttactttgctgccttgatcatttttctgcactcatttggcttgaaggcatagacattccctgttgattatctcggcttggcagtgggtttctgctacacattttgattcctaatatggtagtaggagaggattttgtatgagttccagcgagtttctctgggcttgtggaatgcagcaaggaaagaa

SEQ ID NO: 94724 - DNA, 349 bp, Homo sapiens
taaccaatgacgacaaagcacaaggactccttcctcactttaaagtcaactttacatgtgatatgttttaaatttctacctgcgtatcctatctttaatattactataaagtactactaactttaaaaggctattttaggccgggcgcggtggctcacgcctgtaatcccagcactttgggaggccgaggcgggtggatcatgaggtcaggagatcgagaccatcctggctaacacggtgaaaccccgtctctactaaaaatacaaaaaattagccgggtgcggtggcgggcgcctgtagtcccagctactggggaggctgaggcaggagaatggcgtgaacccgggaa

SEQ ID NO: 94725 - DNA, 317 bp, Homo sapiens
tctgtctcatgcacgggagggctgggctcggggaagcagagaggagcgaaaaacgggatgcaggcaggaaccatggcccggaccctcagagccggagagcagccacgggccctggagtcaccttggcttcccctgcagagggatacacaccctggaggagattctgcctttcctacaacacagtgaaggccattaaaagctctggaggagggggaggggctacctgcggggacaccagatgacacgaagccctggggtttggcttcagtgaacttcttctcccagtgggaggaataccccaccactacacacacaca

SEQ ID NO: 94726 - DNA, 254 bp, Homo sapiens
aaaaagattattttacccatattaaagttgtcatttaagtgccagaagatgtgaaggatgcgaattaattagcctctcgttcagccacgggcactatgtcctggctggaagatgcctcctcccccttcctcctgttcactcatccctttattttatttgtttttattctaaatattatgccataagaggtattatttatttatttatgttttcacctatccctttaatagttccggggagcctgcttcctttca

SEQ ID NO: 94727 - DNA, 822 bp, Homo sapiens
tgccggcccgcgcccgttcttccgcccgtgccgccgcgtctggagctcggcgctcgcccggctgtccctcttccgggggccgcccgccgcgggcctccggagcggcgtcgccggccctttttttttgccggagaaccaaccggagtggcgaggagctgccttgagcgggcctttgtgcccgcagggcccccacggacatccgacagggggccccttacctggtcggctccacccgcagccatcttggaagtgggaagcggccgggagggggaaggggctcgagcgggcagggctcaggcgtagggagccgagcggcggagcgcatcgatggggctcccctgccccggccggtgtgcgggagacggcccgggccccgccgcggaagggaagctttgcgtgacaccggagctcaggccccgccgcggtggtcttgggagcggcgccgtggcgtcctcccagccagcctcagtctcttaatctataaagggcttttccgaacgttctctcttatcgcgctgtgacacggtgcctggcgctgtagttcccaaactggtctgcactttagtattgcctgcggagcttttaatattctgaagcccaggccgattaagtcacagtctctgaagatgagatggaagcatcatcagtttgggaagctgtgtaatgtgcacgcgggtttggaagccactggcctggcgttatctgcatatttggcctcaacattgcacaaactccagagacgggatctatgatcagagccattgtacaaagcgggaaacgggctcagagatgaagccctccgcccaaggacccgggtgggtc

SEQ ID NO: 94728 - DNA, 506 bp, Homo sapiens
gaatgaaccttgtttattcctgggcgtaggctgaactaactttgggaggaacttagtttatagtttaaaataaagatgggctgggcatggcatcccagcactttgggaggccgaggcgggtggattacttaaggtcaggagttcgagaccagcctggccaatatgctgaaaccccacctctactaaaaatacaaaaattagccgcacgtggtggtgtgtgcctgtaatctcagctactcaggaggctgaggcaggagaatcgcttgaatttgtggggtggaggttgcagtgagccaagattgcaccactgcattctagcctgggcagcacagtgagaccctgtatcaaaaacaaacaaacaaacatggtaacagccctttcccgaaacaagcctccttcttgcctggggactagattgcctttgtaggactaacaaagtagccacaagattagaaacaatggcttaggagtcacgcagctggaggctacaaaattctgaccctccc

SEQ ID NO: 94729 - DNA, 376 bp, Homo sapiens
cttgcctctctgcaacccctgcttcccaggttcaagcgactatcctgcctcagcctcccaagtagctggggttacaggcatgtgccgtcaggcctagcaattttttttaagtagagatggggtttcaccacgctggtcaggctggtctccaactcctgacctcaggtgatcctccagcttcagcctcccaaagtgctgggattaacaggcgtgagccaccacacctggcccagttctcctttcaaatgagggaatacatatgtgtttattcctgattcaggataagtgtagggcaccctccacccacttgtagtttttgttttttaaaagttttttttttttttgagaccagttcttgctttgtcattcaggctgg

SEQ ID NO: 94730 - DNA, 538 bp, Homo sapiens
gtgtccccggcatccactctctctcccttcttatcccttccgtgacggatgcctgaggaaccttccccaaactcttctgtcccatccctgccctgctcaaaatccaatcacagctccctaacactcctgaatcaacgtgaagtcctgtcttgagtaatccgtgggccctaactcactcatcccaactcttcactcactgccttgccccacaccctgccagggagcctcccgtggcaccgtggggacacaaaggaaccagggcaaagctccctcagccccattcaaagaggcctggcccacaggctcacggaaagtcagcctctcatgccccgagagctgagtgcaagggagaggcagcgctgtctgtgcttcccatgcagaagcacccccctcccacccctgtgcaggccggccttcgcggcagaccaccatacaccacgttccaagccacactgaggcctccctccaagcctgcggcccccatttccagaccccaccagggcaacctgcatatccacctccctaccctgcccccctc

SEQ ID NO: 94731 - DNA, 288 bp, Homo sapiens
ggggagggctgggtgtgtccagctgccgggttgaagcctaaaagcgaggtcaccccaacctggttctcgtcctggcctgcccgctgtccgcccggcagtgtgggtggactctcagccttgcccctcgcctctgcactctcgcccccaacccccgggaggttggccggcacctgcaccctcgggctgggacgaagagcagactgccagccccgtggtcaccttgcctccctgctgggaggtgtggtcacccgtcacagggcccaggactcaggagagggctcagccctg

SEQ ID NO: 94732 - DNA, 319 bp, Homo sapiens
agaacttgaacagagcactgaagtagaggcaggacagaggcagacaaaaggggagcaagagggcattctaggtaggggcctggcatgagtgagcaaaggcccacaggctgaaagatacagaccccttgtggcagcagtatggtgagagacctgggcacatggaatagagatctggcaatggaccacaaagagagatgaggttggaacccacctttaagagcctggagccagagggagtttcaagggtgttcagaaagagggctcaccccgacttccagtgagacagagtcttgctctgttgcccaggctggagtgcagt

SEQ ID NO: 94733 - DNA, 1099 bp, Homo sapiens
atttctcaagaacataatttacaaagtctgctaacaaaacctatattgacaattaaactttgcctctctcctcttcaactttccaagcaattgtctacgtagtttacattctttttctctctgtaccacctttagtggctattccactttagacaaattctgccaggtacggttggtggcaggggtgcctgatccctctgaagttgaaagcagatcagcagcagcctggctattggtggagctgccagtgaaaagcacccagacgacctacctgatggacccatcatcaggctcaaacagcaccaccagaaaaacacaagaaacctcttacctaaaacataaccaacagtaaaatagaacttataaaaagaagtctctaaaattccacagggggaaaaaacaaagagattaagtaaaatccttactgatacattaggaaataacttgctagtagccttttgatttctgacttgtaaaacctcagaattggagattcaatagctttgtttttatagaggactgtattggaataagttagattattggaaaactttgcatccccaaaatcattgttataagactatagcacttacatctcttcaggagttctaaaaattaagctgaatttcccataagattctcttattaatcacccacaaaagagaaagacagaaaaacccactaaaaatgatgtgcatttgatccagtaaaatgttttaaaaaccataatacagaccacccttgttaatacattttgccccattcctcagttgaactcaggggaaagttcaagatttttaggtcctacctgtaaaaataaaaaatttttctaattaccaaatataaatttcactgtaggatatataggaaaacagaagcacacaaaaaaagaaaattaaaacaaccagtaatcccagcactcagatgaccacttttaatatatcagcattcttcattcttaatctatcctgagatgtgcctcttttacacaaatgatatgttttgtaatgtgctttttttaaattaaaaaatacattctgaacattttttcatgctattaaatatacttttccacaacaactattctcaaaacttttgg

SEQ ID NO: 94734 - DNA, 1107 bp, Homo sapiens
ctcgggtctacctggtctctcggttctacctaggtctctcgagctctaccttggtatctcgtggtctaacgtggtctcctcttcaactttccaagcaattgtctacgtagtttacattctttttctctctgtaccacctttagtggctattccactttagacaaattctgccaggtacggttggtggcaggggtgcctgatccctctgaagttgaaagcagatcagcagcagcctggctattggtggagctgccagtgaaaagcacccagacgacctacctgatggacccatcatcaggctcaaacagcaccaccagaaaaacacaagaaacctcttacctaaaacataaccaacagtaaaatagaacttataaaaagaagtctctaaaattccacagggggaaaaaacaaagagattaagtaaaatccttactgatacattaggaaataacttgctagtagccttttgatttctgacttgtaaaacctcagaattggagattcaatagctttgtttttatagaggactgtattggaataagttagattattggaaaactttgcatccccaaaatcattgttataagactatagcacttacatctcttcaggagttctaaaaattaagctgaatttcccataagattctcttattaatcacccacaaaagagaaagacagaaaaacccactaaaaatgatgtgcatttgatccagtaaaatgttttaaaaaccataatacagaccacccttgttaatacattttgccccattcctcagttgaactcaggggaaagttcaagatttttaggtcctacctgtaaaaataaaaaatttttctaattaccaaatataaatttcactgtaggatatataggaaaacagaagcacacaaaaaaagaaaattaaaacaaccagtaatcccagcactcagatgaccacttttaatatatcagcattcttcattcttaatctatcctgagatgtgcctcttttacacaaatgatatgttttgtaatgtgctttttttaaattaaaaaatacattctgaacattttttcatgctattaaatatacttttccacaacaactattctcaaaacttttgg

SEQ ID NO: 94735 - DNA, 759 bp, Homo sapiens
agcgggggggttctccccaggcccgctggcagcttgttccctgggggcggctcctggacgcagctctttgcaggcccaccaggctcaggggagccaaggcccgtcgcggccaacaggcctgtggagagtaagagtaaggtgggctctgcagggcagcggccgggaaccatgagagaagcgcgtcagtctgggctccaagcgcagcctctcgggattctccgggacccacggcttataatgcgcttaaatcccacgcctcgcacgagagacagcaagtcaccgtcaccgcctaccgcccctgacccgctcccactctcgctgcagcggagggtgtgtgggagagagagggacgcagggagggaaaagcgcggggagggcgaacatcttttcataagctttccgccttctatatgccatctctgatgggagcctctttagatcttttgtccatttactaattgggtggcttgaattcttattgttgagttgtaagtggtttttaatggtctggatgcaagacaggtgttttacaaatattttcttcctgtctgtggcttgtttcttcattctcttaatatttcctttcccagagcaaaagtttttaattgtaacgaagtcacagatgtgactcacagatgtgagccaccgcacccagccaaaattgatacatttaaaatatactatttttaatataaatggaagatggagaatcactatgagtatttcattaatattttgtgggaagcctaataaaaataa

SEQ ID NO: 94736 - DNA, 330 bp, Homo sapiens
gctgtgaatgtacgtggccttggtatgttctccagcaagattataagtggaggatggagtcagctgggaagcgaggctcagatcaaggagggctactaccaggatccctgcagaaacagggacacagggagagatggctgtaaaatccttgagctttaaggggtaagctcatggagccctgaaaaatatgactgcattgcaaatgccaacttgtagacacaaatatcgtggaagcaggccacgttcagccttgcacactgtgcgctcttccatgactgagaacgttagtcacctgcaccctgaccaacctctcatccctgaagcctgctg

SEQ ID NO: 94737 - DNA, 226 bp, Homo sapiens
taataaccacaaggatttacaaagcccagtttgagaaaggtcaccaaaatatatgagttgacttttagagctgatactctaggcttgaaatgaggatgattaaatcttaaaccttcactaaagtttggaagagcctggctggatttgagttttaaagaccgaggcatgattagccttctttttctatcatacccttctcccagtttagctactgagcactgtcttt

SEQ ID NO: 94738 - DNA, 2434 bp, Homo sapiens
  misc_feature (248)..(248): n is a, c, g, or t
  misc_feature (250)..(250): n is a, c, g, or t
gcacgattcgaagaagagtggttagtgaatgaatgagtttcaaaatgtgcaggctgacgtcccgataacctgttttcaacaaccgtagtaaataggaattttcctgggtggtgggaaatggagaagcagcctgcttagacttgagaaaacttcgccaaggtggggccagaaaggaaaggatacttccgcagtgtaatggttggtgtctgttgatgttggcaatgccagtaaaacctcctgttttccgncntctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaaggttggagtgcagtggcacgatcttggctactgcaacctctgtctcccaggttcaagcgattctcctgcctcagcctccctagtagctgagattacagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtctacctaaaatacaaaattagccaggcctggtggcacacacctgtgatcccagctacttgagaggctgaggcaggaaaatagcttgaacccgggagagaggttgcggtgagctgagattgtgccattgcactccagcctgggcaacgagtgaaactctgtctcgagaaaaaagagagagagacagggtttcactttgttgcccaggctggagtgcagtggctgttcacaggtgcggtcataacacgctacagccttggcttcttggcctcgagcagtcctccccgctcagcctcttgtggatttgggaatacaggcgcctgccaccgtgcctggctatttgccacatttcatgtgttgagcttcaggttctgagaggcacatgagagcttagactggcagaaaaggggggtcgtgtccactttcatgtctgcccttttggctcactgcagatagttccctgtgatcccagatgagggccagaatcagttctaagcctaggcctttgggaaaacttagtttgggagtctttgtccttaaaagcctatctgagttcaaacccttgtttttctgctttaaagccatgagatcttgggcaagtcacagccttgatttcttcatccgtaaaagtggtaatagttcctctgtttatcacctgatttaattttggtaaagcactttatgagctgacacagtaaatgtgtatctttgtggttaagaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaggcactgtcagttcctatgtgccccacaggaaagcgcccttaaccactgatgagtgttgatgtttttctgcactagaaggcactatgttgaactattaaacttaccagcactttctttttccactccatagtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 94739 - DNA, 2337 bp, Homo sapiens
  misc_feature (248)..(248): n is a, c, g, or t
  misc_feature (250)..(250): n is a, c, g, or t
gcacgattcgaagaagagtggttagtgaatgaatgagtttcaaaatgtgcaggctgacgtcccgataacctgttttcaacaaccgtagtaaataggaattttcctgggtggtgggaaatggagaagcagcctgcttagacttgagaaaacttcgccaaggtggggccagaaaggaaaggatacttccgcagtgtaatggttggtgtctgttgatgttggcaatgccagtaaaacctcctgttttccgncntctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtctacctaaaatacaaaattagccaggcctggtggcacacacctgtgatcccagctacttgagaggctgaggcaggaaaatagcttgaacccgggagagaggttgcggtgagctgagattgtgccattgcactccagcctgggcaacgagtgaaactctgtctcgagaaaaaagagagagagacagggtttcactttgttgcccaggctggagtgcagtggctgttcacaggtgcggtcataacacgctacagccttggcttcttggcctcgagcagtcctccccgctcagcctcttgtggatttgggaatacaggcgcctgccaccgtgcctggctatttgccacatttcatgtgttgagcttcaggttctgagaggcacatgagagcttagactggcagaaaaggggggtcgtgtccactttcatgtctgcccttttggctcactgcagatagttccctgtgatcccagatgagggccagaatcagttctaagcctaggcctttgggaaaacttagtttgggagtctttgtccttaaaagcctatctgagttcaaacccttgtttttctgctttaaagccatgagatcttgggcaagtcacagccttgatttcttcatccgtaaaagtggtaatagttcctctgtttatcacctgatttaattttggtaaagcactttatgagctgacacagtaaatgtgtatctttgtggttaagaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaggcactgtcagttcctatgtgccccacaggaaagcgcccttaaccactgatgagtgttgatgtttttctgcactagaaggcactatgttgaactattaaacttaccagcactttctttttccactccatagtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 94740 - DNA, 227 bp, Homo sapiens
  misc_feature (1)..(1): n is a, c, g, or t
nttatctagaggatcccttcgatgctgggctctaggttgggccaggctctctggagccaccagccatcctgccctcgtctgtgtggaagctctgcttccgcctctccctcccctgggaggtgcgctggccagggcccatgggagcctcacctcctgtgacctttcggagcacatctccccgtggaacagcgctggtttccaccccactttcttgctcttccttctta

SEQ ID NO: 94741 - DNA, 925 bp, Homo sapiens
gacagaatctctctctgctgcccaggctggagtgcagtgggatgatctcggctcattgaaacctccacctccaggttcaagcgatactcctgcctcaggctcccgagtagctgggactacaagtgtgcaccacgatgcccagatggagtcttgctctgtcgcccaggctggaaagcaatggcgctatcttggctcactgcaacctccgtctcctgggttcaattgattcctctgcctcagcctcccaaatagctggaattacaggacactcagaaaaaaaatgaaattatgagaattgttttctcaaatccttttctactgcaaccttcccaccattacgagcataatgaaactcaaatgtgagtccaaggaattattatcttcatttttctactgaggagaactatcaagacttctaatcacatggaataactcattcaggaaatgaggctgggttgctgatgatggaatgagggagttggagggattagaaatgacgtatccagaatagacaatggaatcggtgacagacttccactagtggcagcaacctgtgcctcactcctgcacaaatccaaaagggtttttgaggcatttgatggcatgtgcctgtgaaacaagtagatattctgtcttgggagcttgagaaaaggccagtagcactgttctagtagcctaaaggcaaacacacatttaaatagtggtggggttagtaggcatgggatgatgagtaatgagcagctcagaaatggtcactttaaagatcaaaggtcatatgcccacattttctgaaatcatgccatttggaatcatcttacatccctaagaataaaaatgttcctaccaaaatcatttagaagaagttttctctgacaactcaccctgttaaaggtcaacatgagattttatcatttacaaaaataaa

SEQ ID NO: 94742 - DNA, 1153 bp, Homo sapiens
ggcctttttttttcttttcttttcttttggtacttcatcaaattcaactgtggcttgaccgatatctaagtgcatttacctctgaaatgattcacaatagtaaactgatttcagcttttaattttagaagacaaaaaatagtttttaagaatcctaaactagctatgtttgagaagacaatagattatgattttataaagagcaaattcctaaaaatatatgcaagatcattactggcccgtggtatttagagaaatgaaatgcacccaccatttggctggacttagtcagacaaacagaataggtggcataacgggtctaattcctaccttgtctggaatatccatccttctgtagttttcctgaacactcatagaggccagtggcagagcccacaggcagagccaccagggtggcgttttttcatgaggcacaaatcatggctttcactcaccacagtccagcacgtaccccaataagttcattcaacatgaaagtatttcaaaaggaaagcaaactgacactggatgaagtatacaatttcaggcgagtctcaaggaacctaacgttcttaatgttcttattcaaacaattactttgggttcaattagttcttcgagtccttttttttttttttcaatttggtcttgaattgcagtatgtgtgaaactgcaaaagccgttcttaccattcaggacatacactgattatacatcttactaaaaactagcagcattgctagactttcagatttacacagtgagttcatagaaaggttatttacggtcggctgtggtggctcatgcctctaatccccactttgggaggccgaggcaggaggatcgcttgagctcaggagttggaaaccagcctgggcaacatggggaaactctgtcccttaaaaataaaaattaaaaattaaaaaaaaaagatataaagagaggttatttactgtgctcatcttccatagtcattccacaaagatgtgtttccaagtctctcaacacccagaaaacgtcaaggggttggatgccttggaaattgtgagattgttaggaggcaggggggagtggccacccggtgtccatagatactggctggcagcagcttttctctgaagttgggcactctttggccccaggctcagcgttcc

SEQ ID NO: 94743 - DNA, 278 bp, Homo sapiens
cctccccttgatgctgtcttgcagaccgctccctgcaacatgagcacaggctctcaccctctgagctgaaacggcctcctgtttctcccagtagtgttccagaaatgccagggcatcattttcacatgatggtgctacagaggcagcaagccagtcagtggcacccaccagtggctgttctgtataaggctctgtgctatggagtcttgagaggtggacagagaaacatattagcagtcagaggccctgggttcaagtccccctgaacatggttaggg

SEQ ID NO: 94744 - DNA, 668 bp, Homo sapiens
cacttttagatcctttgttgacgtagttttatttgattgctacactaactgaaattgtcattggtataaagaaatactgggcaggcacggtggcttacgcctataatcccagctcatttttgtatttttagtagagatgggctatcaccattgtggccaggctagtctcaaactcctgacctcgtgatccacccgcctcggcctcccaaagtgctggggttacaggcatgagccactgcgcccagccaccaaatttatcatttgcatatatattcaataggaatatgcactggtagaaatccatgagtttgcaatctttgttgcaaagatgtttatatttagcaatgtatcttagaagctgattttaaagttttggatggggaaacagaagtcgaacttatggctgtacttgaacacaggaattttaaaagtttttataaagagtgatactaaaattgggtgggattacaggcatcatattccattctcttgagcagtttattttctcttaggcaccatatcattaaaaagctggaagtgataagggaaaaattgcatttcctggtttataatggattccatttccaacttaaagtgtggaaaattaacaaaaattgaagttaatattataggtggtagtggtctttggaggaaggactgggtctcat

SEQ ID NO: 94745 - DNA, 349 bp, Homo sapiens
agattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggat

SEQ ID NO: 94746 - DNA, 387 bp, Homo sapiens
cgagaattgcttgaacctgggagatggagtttgcagtgagccaagattgcatcactgcactccagcctgggcgacagagcaagcaagatctcaccaaaaaaaaaaaaaaaaagaatctaaaaaacaatctgggtgaagatcatttgaagatcaaaaatttaaggtagtaatttcccttttgctttttgaggcagggtcttgttttattgcccaggttggagtacaatggagtgaccacaactcaaattcctgggctcaagggatcctcctgtctcatccttccaagtagttgatacaacagatgcatgccacaatgcctggcttaatttcccattttttgatcaactattattttattctctgaagttacctatttgaggaaaagga

SEQ ID NO: 94747 - DNA, 942 bp, Homo sapiens
agaccagaagacattgttcacaaaacaaaagcaccctcacctgccaatgaatatgcagcgtgcagggggtgtggtgtgagtgttggtggggccccacctctcggagatactgctgtgctgccttcctcactgactgtatacatagtaactgtcatatctttaatgccatggactcactgagccgctctgcaaggactattgtagacaggcacttcacaccataaagtggcatttttttcgttccccaaactgacatttacaagcgataagaaaagagacaatatccatttcattgactgatcattttctagagtatgaagaaatacacacctgggtgtctgcaaggatgtcatcatctttgggtttcatctgagagcatcactcagcatctcacacatagatgttaccatatttttaaatgagctttcctcatccggctccctaagcaagcgctgttggccggtgggagtgactaagtgctccacctgtgggtgtccttcttaatgtgctgcttttgttctgtataaattcacaccacctcactcccaaaagtacttcctgtggctcagaaaaatatgttcaataagattttggatagataaatccatacaaaaataaaaagaggtatagttataaaacaagactacagaaaaagttgtggcagaaattgcatgcaggaaaatcccacaccattagtaaaagtaaggtcaactgtaagttcagctcagggcttcctagcagccatgtttagcgaagtgtgatttttttttttaaacaaaaacaagcaaagatttggaagaaaatgctttagacctaactttacaattattataacataagatgttccagggtccttgaataaatgctgagttttagggaaatgattccaagggaccaagaattggtagaaataatttcaaggcagagaagactaattctaca

SEQ ID NO: 94748 - DNA, 280 bp, Homo sapiens
tcaacgaatgtctttgttttagaaagaggcattttcaagtgttttgatgtgacccaacgtgacctaaaaccattaaaagattctaagcaaaaataataaggccaaactttagtgtaaatagcatgaaaggcttgaaaactaaataaaaaattattttttcctttaagagtaaatagctaggctaggcatggtagttcatacctgtgaacctgtgaaccattgctttggggggctgaggtgaaaggattgcttgagcccagaatttcaagacgagcctggg

SEQ ID NO: 94749 - DNA, 520 bp, Homo sapiens
aagactttttacttaaagatactttctgcatttcagccactttatttcctttccattccttctcttcccaatcctactttttacttaggtgtagtattccttgtagatgtagatttgaagaaaggtgaaagcacagtaattaagacttaatgtttggaagaaattatgatgataggaattaatagaaacagaacaactttgtagtcttccttttcgtcttacccagattatcatatttgccttaaatgagtgagtccaacccaatcagaaggctgttgttgagatctggagagaaaacttgtgatatccaaaagttgcttttggcagcagtgtttatattttcaacgtgagggtgaacaatgctccaggagatacttcaccaagagaaaacagagctactagctgtgaagataatcagtggagctagcaggtctggaggaaactggcagagcagatgtattccacagcatcagttgtaacacacattctcttcaggctgtaatttggggtggaagaaaag

SEQ ID NO: 94750 - DNA, 337 bp, Homo sapiens
tggggtcagatttgtccttgaatgccagtctcacctaaatgtgttatatagcaccttgagagttgctttgccttttttcttgcatcctaccaccagtaaatggtcttactggtcattttataaggattttacgtgaagaaaatgagatgcatatttctgcaaggaaagatccattgtgtatttctatatttgcaaagagtactttagaactttttatgaaaatgaagcatgcctacaggaaagtgtacaggtcctgagcggacagcttaatgagttctcacaaagtgaaaacacctgcatatccagcaccctgaccaagaaacagaacatgaccatt

SEQ ID NO: 94751 - DNA, 684 bp, Homo sapiens
cgcccggcccagtttttctaatcttcttcaccctcccagggctctgagaagtgtgagggtagaatcacctcctgcagatgtttgtggtatagaaatagaaactgcatagtccctcaatatctttatcaggactctaaagataagtggctatgaactgtggcacacttcagagcatactcagagttggggtggattctgatctaacagttgtctaccattaaatgaataactacagtctttgagcaaattcttgctgattacaaaacactatgcaagttaccagagatacaaagatgaataagccatagtctctgctctcaggatctcagcctgctggggagacagctataaccaccagcaactatggcaagcacagagggagcaattaagttggccacagaggaggtaatacttcaactgagcttttgtaagtcctgcccaagttagcatgttggtctctttgggaggccttaatgtgtatgggcagcagaatcccatttaatttattttacatccagtttgacaaatggctctccttgccatggatatgcaagataaatatgcctccaaaatgtgatctcagagcaatttagaaactaagtggcaaatatcctatacatcaagatgacagtgacattgagaaacatgtggtttgttaatccacagtgggatcaagatcaggct

SEQ ID NO: 94752 - DNA, 626 bp, Homo sapiens
tgcagtgagccgagatggcaccagtgcactctagcctgggcaacagagcaagactctgtctcaaaaataaatatataaataaataaatggatttttcgacatgtagaccaggaatatgagaccttaaaaacaatatctatgttgcaggtttccaaatattatcaggtgtatctctttctgctagtattttatttctatttaacgttcaagtattttactatatttagggacctttccatttcctggttattgcaccaattactgtaacattattaataaattaacatgatgttttgcaaaaatgtaaattaaactgagagcagaagtgacatcgccctgacataaaacagtgaagcagcactttcgttcttaccaaacaaaggccaactgttttaatctcccgacccacccgtgggtgaaaaacaagaaatattcacttaatcgagagccacatgcaaagtgccagaagctctgctctgctcagggaagataccacatcctagagagcatttgtaagtagtgatttaaatttatggaactctgccctcattttataatgtatctgattttggtagaggccatttaggttaagtggagagggatgtaaaaagactaccatcccctgt

SEQ ID NO: 94753 - DNA, 239 bp, Homo sapiens
gcctctgcatagtgcatgatccatcagactttgcccagctgctctgatagtctttaactctgcattgtatctgtgaaaattgctgtggcagaaataggctggaatgtttacctaatgctcttccactaaatacccaaaggattctggaatgtgctacaagcagcatagctcctacttttttctccttctgaaaacagtactaaacaggggccgacctcagggtggtgggagtgggtgac

SEQ ID NO: 94754 - DNA, 148 bp, Homo sapiens
caggatatttccttctgtctttgaatatgccttttgtttctaatttgtgcaactataacttcacgtgaacctcatggattctggcttaggcaagtggcttctatgtaattagcagtgattccatcttaataaggtcctgtgatctgac

SEQ ID NO: 94755 - DNA, 325 bp, Homo sapiens
tgaccaggaggtgatgggtcaggccaccattaaactgcctctctcaaataacagatgattgctgggagccccgccggggacgggcagtcccccagacagacagaaaccctggaaggtggcgatgagcagctccccgagatctcagggggtgggcgagggggttcacgcttgcgcattcacaggcaaaccggccgggtttcactgtcctatgaccctccctgggcaacatccaactgccgagggaggcacgcctcaagtgagcacccctacgactccaggaaacacgctgcgcctgcggtccctcccaagtgccgacaggccactg

SEQ ID NO: 94756 - DNA, 329 bp, Homo sapiens
acatatgttaaagttgtacaaaaagaggaggtgctacactagtttcctcaaagcacacagaggtaggattgctggtgtgctcaaaaggcaatgtaatttcctaacttaagctgtctattccatgtagttactatagaagagctatagcatctagaattttcttagtgtcatttacagagaatcaagaaatattgtcagtgggtacggaagccttaatggagacacttaataagctagggatattttagaaggaaatgaacaaagtctttatgagtccattttttcttttctatttatagttccttaatagtttttcatggtagctggaa

SEQ ID NO: 94757 - DNA, 323 bp, Homo sapiens
ttacaagcagtgctgtagtgcataacactatacatacgtcatcttatatgatgataagtgtatctgtaggattgctatccagaagtggaattgctaggttaatagtttatgcaattgtaattttttttaagagatgaagtttcactgtgttgcccagacttgagtgcagtggctatttacagatgctattatagctcaccacagccttgaactcctggcctcaagtagtcctcctgtcttagcctctcaagtacccaggattacaggtgtgtgccagcacacccagcttgtaattgtgattttgaaagacattacttaattgc

SEQ ID NO: 94758 - DNA, 615 bp, Homo sapiens
tataactctaccattgtatgcatctgatcattttcacattaaagaagaaagtgcttttcagtcagccaggtgtgatggctcatgcctgtaattgcagcactttgggaggccaaggcgggcagatcatcaggtcaggagattgagaccatcctggctaacagggtgaaatcccatctctactaaaaatacaaaaaattagtcaggcgtggtggcgggcgcctgtagtcccagccactcgggcgggggcaaaagaatcgcttgaacccgggaggcggaggttgcagtgagccgggattgcgccattgcactccagcctgggcgacagagcgagatttcctcccaaaaaaaaaaagaaaagaaagtgctttttagtcatctgcctcatggttgaaaagtggactgtgggactatgcagtggcagaggcccaggaagaggctaccagagagctggagtgcagggaggggctgagtgggaagagcagacaggacaaggggtagaccccagcagatccccagggcctggggctgaagcaaccccaagctaatccttgcagagatcggggaggactggggaggtctgttctaagtcttagacgtctagtctagggagcactt

SEQ ID NO: 94759 - DNA, 504 bp, Homo sapiens
gccgggactacaggcgcctgccaccacgcctggctaattttttgtgtttttagtagagacagggtttccctgtggtagccaggatggtctcgatttcctgatcttgtgatccacctgcctcggcctcgcaaagttctgggattacaggcgtgagccaccgtgcccggccccaggctggtaattttttattttttgtagaggcagggtttctttgttgctctgtgtggacagaaagcttagtttgtttctctgatggttagtcccccacagaattttaacgtgattctgtgttgatgacactttctgttgcatgagacaatattccagatctctctgggtccctcctggattcaaggcatcctcctgcctcggcctcccgagtagctgggaccacaggtatgtgtcacagcccaaggcctccagcacaagccttattctcccatccccagactcaggaggccatgcagccacacaccgggggagggttccagacgtcactgtggg

SEQ ID NO: 94760 - DNA, 570 bp, Homo sapiens
ttactatccaaattaaaaatctgctgttctccctcccatattctttgcgaatgaagattcccctgtttgtttggatagttttccaaattcattactgcattcctggcatccgcagcaagctaagagttagttaatatttttaatatagcaaataaggatgagggatgcccttcatgtgtatttacacaccagatttttatggtacatagggagtaatctagggaaaagatatattaggcatgaatcttagctgtggtagaagcacagctcaaattagcttaaggaaaaaaaaaaaaaagctggctcatagaacttgaggacagtggtggccatgactatgggcttgattggatctagtgactcaagctcccttccatttggccctccaaccacccccccatccctccaccaatcataccttctgttggcctctgcagtagagtgggcctcttctgggcccttccacatgccaggggatatggccaccagcagttctggggaaaccattagtaatttgtgatcgtagagatttgctcccagtattccctagggcaaaaatattgggagttc

SEQ ID NO: 94761 - DNA, 313 bp, Homo sapiens
actcctagagtatccccagctctggaaaaggggggccttcggggacaatggctgcccttatgactgctgttatcattaattcttttattgtaattatttaaatgtgctataatatttcatatatattcaaattttatcaccaaaaataaaatcagcatgcttgcaacatagatgaagtccctcaaatctcagggccatagtttctcctctgctgctgagagaggttggcctctctggttttggagatcatttttttgagagagtttcactcacccaggctggagtgcagtggcacaatctcagctcactgcaa

SEQ ID NO: 94762 - DNA, 399 bp, Homo sapiens
gagaactgcccaggttggacaaaagcatggagtttgctaaggggcaagaaaggtcaccacgtctctgagaagatatttggctggaaatggtaggttatgaaaaaccatgtcgtgtgaaatcagttttccctcatggattaatattttcctccagaaagacgcaaatgtagaaagccattttatttaacaggtaaattgtgtgtttggggttaaaatgttttgaaattggtggggtggcactcccaccctccaagtcaccctcccctcagactggcctccccatcagcctgcggagggggtgttaactttgctccagtttcctcctctcaagccactgctacctccttctacctccttcatgacctttcaccttgatgagggcaatggcctctgggcttc

SEQ ID NO: 94763 - DNA, 330 bp, Homo sapiens
tcatggtaattattttacctttcccaactgggagttactatgctattaaaataatggcctaaggcagtttacatagcatgcatttaaatattaagagaatctatttgtgtttttctgttggacatttttgtcttaattgatctatttcttccacattaatatgtattagtcttaataaagacactggctatgttcaagtggccaaagatagaccacttttctaagagtttattcagaagaaatatctcatccaaagttaccttcaatgcaagcttcacaatttgacaatgtgcatttggaaccataatccctggcctgggttttctactt

SEQ ID NO: 94764 - DNA, 1362 bp, Homo sapiens
agcgggaggggcagacgggctcgcgcgcgcgccgtctgctgaggtccctcgggaaggaggagagcgtcctgacgccgacccgcaggcgcagcccggcagtcggcggcgcgccgagggcggaggtggtgcgtgcgtgcgtgtgtgtgtgtgtgtgtgtgtgtgtgtgtgtggagctcgggtgccaaggggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgtaagtacaagccttttagaaaaatgttggtagcatg

SEQ ID NO: 94765 - DNA, 890 bp, Homo sapiens
gcagtgagctgtgatcgtgccatcatgccactgcaatctagcctgggcaatagaatgagaccctgtctcaaaacaaacaacaacaacaaaactttggaataacaggaagaaaggatacagtaaacaagaatatgggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgtaagtacaagccttttagaaaaatgttggtagcatg

SEQ ID NO: 94766 - DNA, 1105 bp, Homo sapiens
agcgggaggggcagacgggctcgcgcgcgcgccgtctgctgaggtccctcgggaaggaggagagcgtcctgacgccgacccgcaggcgcagcccggcagtcggcggcgcgccgagggcggaggtggtgcgtgcgtgcgtgtgtgtgtgtgtgtgtgtgtgtgtgtgtgtggagctcgggtgccaaggggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaaggtcaagtaacctggtttggttatgaaagtcctcgtagcttctgggactatatcagagtggcttgccggaaagtttcacagaattgtatctgcagcattgaaaatatggaaaatgtcagttcttctagagctaaggtaagacattggtcagagactcgtttctattttttttttcattgcatgtatttggaatagcaggaaggtgtgaagctacttactatgaatttccttttcttaagaagcataataaaatacgtcctgttctgtgatgtttctacatttcttgaattatctaaactagtggctctcaaataatgttcagcagaaccctgaagatgtccaagaccctttctttaatgggtacaaaatgtcaaaaatatttttatataatatcaacctgttatttgccttttcgctgtgttgatatttgcactgccaatgcagacacaatggtggataaaactgttggaaccttagcacgaattaatgcagtgacatc

SEQ ID NO: 94767 - DNA, 254 bp, Homo sapiens
tctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaaggtattttaaaattatcaaaacgtacttaattttattctagttattgcctttgaactgtgactgccaaaatattttttaactgaata

SEQ ID NO: 94768 - DNA, 461 bp, Homo sapiens
tatatttgattctttcttcttccttttagggtagagcctggatcagagtagcactcatggaaaaacatttatctgaatacatctctacagctctgagagacttcaaaacaaccaggtttaaaagtccttttaattttctaatatatatttgaaagaatcacctgaagactcagaaatcagaataggatgaagaatcaatttctaaaatcctcaactgttttatttcctccttttgttactactcagataaatccactgtcttcttaggaaaatgtaatttgtcaactaaacatacatctacctttctgtaaaaagatacacattacgcctggaatatcctttttctaaatcatttctgattcatactctttcaactcttgaagcttcattctccccatagactattccctgatggatttgaatttaagtatgaaatttcaatagcatcttttttcttttca

SEQ ID NO: 94769 - DNA, 487 bp, Homo sapiens
aaaaataaaaaataaaaaatattttttaaataaacagtatgatcccacactgttctctctgcctgtttagggtgtttagagctggccccttgttcagatcatagtgcagacctcacctcgagagcctttcctgacaaccctatcagcctgggcctcaccctcccttgtatcatagtctcagcatcctcttcttaataacaccttgagatgatatatttgtttactgattttgggactcttccccgccatagactgagtcccctgagagcagagctgagatctgagttgtgcatgaccgtatctataaaccacatccaactggccgcctgtttttgtgagccaggaaggtttttcaaaggtgaacatgtaccatcaattgacgacaggaaatacaactgggagccccaattaagtgaaatgttatcccccaaaagaattccactcttatgaatagacttgggtcttagtccattttgcatcgctataa

SEQ ID NO: 94770 - DNA, 234 bp, Homo sapiens
tgtttaactgccaactgccccataaaggcttccagggcattcttcagtggaaggattctctcaccggctgcagcactttctcattctttctcaccccggagtgtttgtccagcttactcatgagcttactcttgaggtgatgtttacttacagaattgccttttttttttttttttttgagacgaagtctcactctgtccccaggctggagtgcagtggcacaatctcgctcac

SEQ ID NO: 94771 - DNA, 296 bp, Homo sapiens
agagacaaggttttgccatgttccccagggtagtctcaaactcctgagctcaagtgatccacctgtgctggcctcccaaagtgttgggattatagatgtgagccactgcgcccagccaaaagacaactttaaaaactttagtctgaaggcttagagagactcaagaggattgatatccaccaaagtcaactagaaagataacagatttccatgcaaagcagaaatcagagcaggaaaggttcaaaggcatgacagttaaaacagaaaatgtaatagaattgataaaatgacacatc

SEQ ID NO: 94772 - DNA, 292 bp, Homo sapiens
gagctgtgctctctggggccacttagcactctgggcatgcactccagcctttgtctgggagcactcttggggtttaacagaacagttgttcaatataaagtgcctcctggcagagacaatagctctagatgtctctccactcagtgcccctcccatcacttcctccctgtcttcatgctaattgtgctctggaattcttccagattgcatttaggagtgatgggttatgattacacctcttaacaaggtcaagtaccccatgtgcccagtgcaaaggggtatatagaaacca

SEQ ID NO: 94773 - DNA, 255 bp, Homo sapiens
cctttgagataaggcagaatttcccaaactaacatttagaagaaccctctctaggaggttaatagatattatatagcgtatccgggcatggtggctcacgcctgtaatcccagcactgtgggaggccgaggtaggcacttgaggccaggctggtcttgaactcctgacttcgagtgattcgcctgccttggcctcccaaagtgctgggattatagccgtgagccattgtgccgggccacactatgcacttctata

SEQ ID NO: 94774 - DNA, 516 bp, Homo sapiens
gcagcgcagtaggaaaatgagaaaatcctagggtctatataaagtgatgctttgttacccacatgtatggcaaatgtctctcattaatgcctttgataaggtgggaaactgtctggtgttggaggatcaggctggttttgaattctggctgttaagcttaatagcagtgtgatggtgagcaagtgacttcaaactctctagagccttggtttcttcctctgtaaaatgggaatcattgttcttagctcccatgagcttattccagttgtgagaagtaactggggcaatgtatgtaaactgcctagcatataccttcaccctgttcctttaatggaataaaaaaaggctgaggctgaggaagaggacagtgaaaagcatgggttcagccagcctaggttagaatctcacttgctcactgcatgaccttggggaggcactcatcttttccgagcctcagtttccttttctgggaaagcaggataaaaataggacctactttgtcacaccgctgtgtgg

SEQ ID NO: 94775 - DNA, 215 bp, Homo sapiens
caatataaaacatagtttaataaggcttaaaaagatttagtatctatatccttctgaaaatagtagcatatacatttttgaaatgtcctcttggttattacagtaggaatatataggtaaaattggaatatagttctttctcaaaataaaattatacctatgatgtactttgcagtataagggaagaaaaatataatcaatgagatagccagatc

SEQ ID NO: 94776 - DNA, 1205 bp, Homo sapiens
atattttagttctgttgaaactctcccattctttctgaaacttggattttttttgtgaaaacttgagtcttaaaaacacatccatagttcaccctgaagtttgaagacctcacttgactgatggagcgagagccccgctaacctgcactctggtctctaaggtgcagtcatcgagaagtcctgagcggccgtgcaggtttcccgatctggaaaagagaaatgttgctgaggacaggatgaggtagataaggggctgccctttgttttggaccagttgcatttgcactgaggttagaattggcagctatgttgatttttatatcaaaatccaagatcgtgcttccataactaaaagctttataaacaacttaaaaattggcagtgttggtaggaagaaataaaggcacaatccagaattgagaggtgatttgtgtcctttagggcagggacttttataatcccgcagtgtgtaccttggtgtatagttgttaagccaagtgcacagtgccttgtgagtaccagggttcccatcagacaaactagaaaaggggatcccagacatgctgctgctgtttcactgtggagcatgacttagcagtattgaaacagatctgactttttgcttggcagcacaaaaatgatgttattttagaaactctgttggaaagtataggcatgaaactagtctgaggtgagaggcctgccttttcagaaaagttttaatgaaacacgaagtaattagcttttttgtatgtttagtggcacaatttttaatttcgttgaagtttgtaataattttaactgctttttaatatgtgtaccactcatttgtatgcaaccatggacaacttaaaaaaatacttttgtgttctttttctcccttttatttttagttaatacataataacacatttgtgggatacaaagtgatatttcagtacatgtatacaacgtgtaatgatcaaagcacagtaatcagcatatccatcacctcagatgtttatcatttctttgtgttgggaacattcagaattctctcttctagctttttgaaaatatacaatagattgttgttaagtatatttaccttgaaatactacagagcactagaacttattgagctgcaattttgtatcaacctctccctctcctctcctcccactagccttcccagcttctaataaaccacaattcaagtctctact

SEQ ID NO: 94777 - DNA, 984 bp, Homo sapiens
  misc_feature (861)..(861): n is a, c, g, or t
atattttagttctgttgaaactctcccattctttctgaaacttggattttttttgtgaaaacttgagtcttaaaaacacatccatagttcaccctgaagtttgaagacctcacttgactgatggagcgagagccccgctaacctgcactctggtctctaaggtgcagtcatcgagaagtcctgagcggccgtgcaggtttcccgatctggaaaagagaaatgttgctgaggacaggatgaggtagataaggggctgccctttgttttggaccagttgcatttgcactgaggttagaattggcagctatgttgatttttatatcaaaatccaagatcgtgcttccataactaaaagctttataaacaacttaaaaattggcagtgttggtaggaagaaataaaggcacaatccagaattgagaggtgatttgtgtcctttagggcagggacttttataatcccgcagtgtgtaccttggtgtatagttgttaagccaagtgcacagtgccttgtgagtaccagggttcccatcagacaaactagaaaaggggatcccagacatgctgctgctgtttcactgtggagcatgacttagcagtattgaaacagatctgactttttgcttggcagcacaaaaatgatgttattttagaaactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcnctggaataactttaaaaaagaattacaatacatggctttttagaatttcgttacgtatgttaagatttgtgtacaaattgaaatgtctgtactgatcctcaaccaataaaatctcagttatga

SEQ ID NO: 94778 - DNA, 704 bp, Homo sapiens
agaagataagcatggcccctgcacaaggatgacacacaaatttgtgaagcgttccatatttttctgcacatgtatcccagaacttaaagtaaattaaataataataataataataagtctggctactaaatagggttttcagagcatgatttcagaagagatgtgaaataggtaaattgatctttaagctcttttttacataaaatattcccagtaacctcctacttcctcctagttgcataattctcttacttctaaaagcaactccatatacattctttggaaatattctatttttagtacattttaacactccaatctgcttcacattttgcctaactggtcctggtcttggccttttggagtcttttctcctaaataaagctagaatgcctccatcatcctgattacatggtttgctcagatgtgcttgctgaatttcatgacctcactcccccttataaactggtgaggatgtactcatgagcatggagtacatttttatccttaaaaccacattcatggcagagaacacacaccaaagcaagatttttcttaatctcttgctcaattcaatattttagaaaatgttgtaaaaatagtggaaggtgatttcattacaagattggggaaaacacctctatctatgaccatcttctatacctaaatctcatttctattcagataaaaatctgattatccca

SEQ ID NO: 94779 - DNA, 643 bp, Homo sapiens
agcggatctcttccggttatggcgcccgctgggagtgtcttatcagccgcttataccgcggaaactttaacctgcgttttcccgtaaaattttcctctctaggtttcgtatcattgtcttgtttcttactcttgtattaactttgttttaacctaaggtttctctttcccaaaaactgtggtgtttctttacaacctctttttatagttatataaacattgcaagaaccatgattttatattcttccttttcagtattaataacttcaatgtcttttttggcatttgtctgaaaatttgaaatatttttcaatttactgaactgattatcgttttgtaaatatcggatactactttaatcatttgtgtattggccttaagattctctatttttaactcttccaccaacatacctttaatctgagaggtgttgtaggggcttcaagatcaaactttccccacagtctctattttcattataaaataccgtgttttaagaaaaaatgtacaaggttgaaagaagtttcactactacgtgttttttttttaatttttattttattttattttattttgagacggagtctcgctctgtcaccaggctggagtgcagtggtgcggtctcggctcactgcaacccccga

SEQ ID NO: 94780 - DNA, 819 bp, Homo sapiens
ataagacggatgcggaaaccgagacgggctggatgggaaactctttccaggaaggctccggggccctcagctggtctccgaccttcccctgcaacctgtgacacctgccattttcccatcttaggcgatggcaacgccacccttccgtttgctccgggcaaaacttcgagagttccctctgactctggagatttttcctcacatccaagagccaactggtcatcaattcgtgatttcccatcggctaagtgcgtgggcattgagctacacgcgagtctctccacctctgcggaatagctacttcggggtaggggaggggccctcccgtggattgtaaggtgtttagcagcagccgtcgcctccgctgactagatacatgccagggggttagcattctccctccccgcttcccccattcgtgacctagtgtcccagcggggatgggagaggcgtgtaagggcgaagttgccccctcttgagaaccactgatgcgcgttgtcctgctgtctgagcttgtgcagaggactctccagatgaaggctcaggggtcgatccagcttgagaccccctcgctcccccgcacagtcggaccttaggattggagatttttaacatctctgcgtcatgagattcgaaacctttaggtcttttcttccgttctgtcctccaaatcggcctcttccgagcctgttgaccagggccagccaggcagagggctgggtttgctcaacgaggctcctctcggccctcctggagcttcaggcctctttcggttgcagagaagctttatgggtcacttccttcggcatccccgggggc

SEQ ID NO: 94781 - DNA, 240 bp, Homo sapiens
tacaagaggctacatgctatatgatttcatttataagatattctggaaaaggcaaaactataggaaatcagattagtagctaacgggctgacggtgggaggaggtgattgactacaaagggacacgagggacctttttgaggcgacagaaatgctttatattgggaatgtggtggtggttatgtaactatacatttgtcaaaactcatcaaattgtacacttaaaaagggtgaatgttag

SEQ ID NO: 94782 - DNA, 433 bp, Homo sapiens
ggtggtaggttcaaaactgagcatgtttacagtgtaaatagaaagattgtgtgttcaagatgtaaggaatagttgatgtccccagatacgctattatttcaaaattttaacctttaccaagattctcattctcagttttaccatggagaatgaaaaaagtagtacatttaataagtttcctttctgaatatatctctaatgattatttaagcatattttaaatttctttttcatacttttaacgaaacactaaagctttttaaaaattgatagttcagttttatatttatgtcacaaaatatttcttcaccatcttccaggtgcccaggtgattttatatgttgtttaatttaattttccatagcattttcatagatttctttattcggaagtattaccaaggacaaaaatgttcctaataaaaattttttaa

SEQ ID NO: 94783 - DNA, 338 bp, Homo sapiens
cagaactttatctaaattgactgagaaaaatcaaattagtaaaatcagtaatgaaggacatttctaatgaccttattaaatgtatacatatattaaaacatcacattgtaccgcataaatatgtaaaattattgtttgtcacttggaccagatggtgtggttgtgaattctactaaacctttaaagaagaattaatatcaatacaatatttactttggctatcaaaatacagaaagagatgaatcatgagaaaaaaatctaaactacagaaaaatatcccttatgaagacaaatataaacatcctcacaaaattttaacagaatccaacacagtcaaa

SEQ ID NO: 94784 - DNA, 499 bp, Homo sapiens
tgctcagcatggaaatagtattattacttaatcactgcaatctccacctcccgggttcaagcgattctcctgcctcagcctccccagtagctgggactacaggcgtgtaccaccaggcctggctggctaatttttgtatttttagcacagatggggtttcaccatgttggtcaggctggtctcgaactcctgacctcaagtgacccacctgcctcagccccccaaagtgctgggattacaggcgtgagccactgcacctggccaccacctgttttatttcatgtcttcctcggctgttttacctcaaaggcctagcataagccatgacatagtgggcactaaatgaagaggttaaactaacacatttatgtggtaagtaatccatctaaaatgtatcacactacctagtttattattttgaaagtatgtgcagcactcacttcgggaaaagttaatgaaaggctaagccagtctacaaaagtctgctcacctaacccac

SEQ ID NO: 94785 - DNA, 325 bp, Homo sapiens
gacagcactaataggtccatgactgggtccaggttctgcctgggatgattggcaaagagctcactgacagtgttgaaggcatctgtggtgaagtggatgggctggtccagctccaaggcctggctgaggctgaagaactggcagccttctgatgctccttcttaaagcctgtcaccatcacctgcttgcatgtcaactcattggctgtgaagttgagccgagtgccctgttgttcatcttcttggtgaagcatttgaagctgtcgatcttgctctcccactcctaaagtttgagtgtcaccctggacagtaggctcagagcccgg

SEQ ID NO: 94786 - DNA, 681 bp, Homo sapiens
ggaaaacatttttcagtcattcaatagtctgttgtgaataaagcaaaaatagttaacaaggcagcgctactctgtgctgggccctgtactaatgttctatgtaaacccatgaggtcagcactgtttgtttctctggttggtagatgtgggaaactgagtcttggggaggtcagaggacatgctggcctcccacccccagcccccccacccagctagtaaaggcagagctgagattggaacatattgttgaactttcaccaatacaaacaaaagccttctttttccaaaacaagtacctttgaaagacttcaaaatgtaagagtaggttctcctgggtggagataatgaggctcaacactgtttatccttataatatccctgggaggtggtaggagtcagagagctttagcttctattgaagggagaagccccacggtcagaagacagtaaaaagccttctagggtgacagggaatggacttcacaagagttctcttgtaatgacttcattctggcgtttcttttaaagcatgttgccttatgattccattacttttatttgtggaatttatggttaattttgatattgaagaggaaagcatttattgaagacatatttaaacagtaccagcaacaacttgtgcttgctaaatcagacccatcggaatgtgggcgtatatgt

SEQ ID NO: 94787 - DNA, 445 bp, Homo sapiens
tagctggttctccactcttacattacattgggctatactcctggcaaagctcctttgaatctcagaaatattttcttccctgttctttgtttcccaatgcctactatacccctgtattagtccattttcatactgctgtgaagaaatacccaagactgggtaatttataaagaaaaagagctttaatggactcacagttccacatgactggggaggcctcacaatcatggcagaaggcgaaagaggaacaaaggcacatcttacatggcagcaggcaagagagtgtgtgaagggtaactgccctttataaaaccatcagatctcatgagacttattcacgcagggaaaaaaaccacctcatgattcaattaccttccaccgagttcctctcatgacatgtggggattatgggagctacaattcaaaatgagatttgggtggggac

SEQ ID NO: 94788 - DNA, 532 bp, Homo sapiens
caacccctgtggctggaggaggccttggaggcctgtggggggataagcagctgataaaccttgaagaatggaagccttggctgtagttctgagtgaccatcagtggctgctgccccactgcctgggaacacagaaacccagagtccagggtggtagagggggctcaccctctgaccaagttgctctcctccctctcctgggtaccctctgtcattgttctacctctgtgcctttataattttattctccagcttcccatcttgaaatacggcccttctccctcaccagtgtgaatgtccttcttcaaatccctgtctcagtgtcctccttcctgccctctgcaactacccaggcccatcttgagtacttcttcctcagatctcagataataatacacagtcacatgtagatgacactctgtcatttacaaggcacattagtggtgatcatctcatcttcagtttcacagtcaatctgtgaggcagggatcagcatgcccattttacagaggatgaactgaggctaagaggca

SEQ ID NO: 94789 - DNA, 449 bp, Homo sapiens
ccatgttggccaaaatggtcttgatctcttgagctcatggttcgcccaccttggcctcccaaaatgctgagatgacaggtgtgagccaccatgcctggcctagagttcactcttgatgtacattctatggtttgtacaaatacataatgcaatgtatttaccattatgatgttgtacaaatagtacatatgttaaaatcccctgtgcttcacctgttcacttctctttccccacccagcctttggcaaccactgatctttttagtctccatagttttgccttttccagaatgtcatgtagttggaatcatgtagtatgcagcctcctcagcttggcttcttacattcacagtatgcatttaagtttcctctgtgtctttttctggcttagtagctcatttctccagcctgggggacagagcaagactctgtctaaataaataaataaat

SEQ ID NO: 94790 - DNA, 140 bp, Homo sapiens
gtttatcatcctctttttattttgaatctcctttgtgtagttttagaatgagtattggcagactaaggtgcagagaattatttagaactccttgttcagatattgaatcttccatgtcagctaaacaatcctttcctgtt

SEQ ID NO: 94791 - DNA, 280 bp, Homo sapiens
cagcagtgggagacacagcacagccaccagggcagcccccaggcagacggcgggcctagagagggcgggatgacacaagaaaggttctcctttggagacggcgaggtcaggcaggtgggagagggttcacggtgcttgaggtgcagagagaggatggtggaatggaaaacgtagggtgacttgtcggggacaggcccagggccacaactcgggcaggcctattgcccgagttttgggtcccatcctggcaggcaggggagagaattctgaattttttaat

SEQ ID NO: 94792 - DNA, 234 bp, Homo sapiens
tatataggcaatgggccgagtgcatgctccggcgcatggcggcgcggaattcgattagtcacatgggccggtcaacttttttttagccattcatcccaggctgcagctgggtgacgtcagaggtgacttggaatggcaacagatggtgcctgagcttgtaggaccgttggggagcaccgtgggaggctcagaatgctggggcagtccctaatagtgatgctgctgctcctgacc

SEQ ID NO: 94793 - DNA, 390 bp, Homo sapiens
atcaaatcagggtaaatggagtatccatcacctcaagcatttatcatttttttgtgttagaaatattccaattccactcttttagttatcttagaatataaaataaattagtgttaactatagtcaccctattgtgctaccaaatactagatcttattcatcctatctaactgtatttttgtacccattaatcatccccactttatccacccacttcttgccacccttcacagcctctggtatccatcattctactatctccaagagttaaattttattttttttaagctcccacacatgtgtgagaatatacaatatttgtctttctgtgtctgggatattttacttaacataatgtcctctagttccatccatgttgttgcaaatgac

SEQ ID NO: 94794 - DNA, 358 bp, Homo sapiens
agctaaattgtagcctcttctccacctgccataacagcaggagccaggaggcctagtgaacttcaaagggcaggccctgcctgaggccctggtttaaaatgcagattcctgggccctatcccagggccactgagtcaggctctctgcaggttgtttcaggaaactgcacgcttagaggattcttaagcacactgaagcttaagatccctggcagggatttccaagaagggtacaggccctgcagaaggtatgagaagcaaggattagagcttctatttaaaatatagttgaccagctgggtgggtggctcatgcttgtaatcccagcacatagggaggccgaggcaggaggatcattt

SEQ ID NO: 94795 - DNA, 215 bp, Homo sapiens
gagtatcccagaatagtgtcaagtctcccctacctttccaagccattgctctaggactgaccagctgcaacacacctttgctggaagcttcagtgagggcctctgccccaggccagtcccttcctgtgccctgtacctaccggcactgaagactgccatctagtggccattgccctttctttttcttttgctggtaaaggaaacggagtctccca

SEQ ID NO: 94796 - DNA, 549 bp, Homo sapiens
tgaatccaaataccaactattttcaaataaaagaaaggagaggcaagacttagcagcagcaggctttttacagtccttcaggtttcaattgtgggaccttacacgtggtgctattgcagctccaattttgtttttttcttttaacccatcatttcagcttgttaaactttggagattcatattctgtcattgagagttgtccttccttcctttgctgcttcagaggacttagtgatgcctttattagagcttttactacattgcattatggctctttatgtctttcctcctgagttctgctaggatcataatcatgtctcatcatattcctcttctctcttcaacactgacagctcatagtaagtgcttaatacattttcattgaatgaatgagtcaaaagtatttgctcttccaaattctgcttattgatagtttattaataattatatattattcatgctgtttcaatatttatcgtacttatttgaatatatacatttatatttatataaagtaataaatgtgggtattttattaataaataagtt

SEQ ID NO: 94797 - DNA, 440 bp, Homo sapiens
attactgagcgtggattgtaaggtagaaattacccattaaatttcacactcctagtaacccttctccttcagatagattaagttttgagaatgacaaaaagaacaacagtgtacatgacggcttcatcatctttactgtattgcctataatagccatctgattatatccaagcagcactgggcataccgagaagcttaacagacactgccagatacacatttgtacatgtggaattgtgtgctgaatactaacaacacctaccgtgtgcctgatgtttcctaagtgcttcatacatatgaacccatttaatctttaaaacaactgcatgatatacaaggattgaatccatcaccctgaatgaggacatcaaggtatgaagacatctagcaactcctttaagatcctgtaaattgcaaataaaataactggaatctgaacc

SEQ ID NO: 94798 - DNA, 3032 bp, Homo sapiens
cggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 94799 - DNA, 3734 bp, Homo sapiens
  misc_feature (2961)..(2963): n is a, c, g, or t
  misc_feature (2965)..(2966): n is a, c, g, or t
cggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctgnnnannctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccagcgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctaaac

SEQ ID NO: 94800 - DNA, 1224 bp, Homo sapiens
  misc_feature (451)..(453): n is a, c, g, or t
  misc_feature (455)..(456): n is a, c, g, or t
gccggtgtgaatcggacgaggcagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctgnnnannctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccagcgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctaaac

SEQ ID NO: 94801 - DNA, 3717 bp, Homo sapiens
  misc_feature (2944)..(2946): n is a, c, g, or t
  misc_feature (2948)..(2949): n is a, c, g, or t
cggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctgnnnannctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccagcgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctaaac

SEQ ID NO: 94802 - DNA, 2939 bp, Homo sapiens
cggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 94803 - DNA, 2933 bp, Homo sapiens
cggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcataatcgacgggcggcacctcgcggaatatttttagaagtctttgtgtaaattaatgtctgttgtgctgtgttaaggacgatgcgtaaactgtgtgcctactgaacctggaaatagaacttccccctgc

SEQ ID NO: 94804 - DNA, 3151 bp, Homo sapiens
cggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctgtgagtgtgggtctggggacccaagattccccagcgcccagggctttcacctgtcccaccctctgcagctaaggaaaccccctttctggacccttggcgtcccaggtccctgtgccttgctcagccagctgcctggcgtaggcagctcacccaagtgctcctgccctacccctgattctgccacgccaggctcaggggctggtgtccctcagggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 94805 - DNA, 252 bp, Homo sapiens
cccctgtctttcaaaagcagttacagcacagccaggagagccgtgtgcatgcacctcccctaccatttcaaacacatgccttggaaacttcgccctgcttttccgagtatcaagtccatcaaataacaaatgatagtgtaaagacagggcacttaatcacgttatgtggcatgattagtagccgtctccagaattcaggcaacttataaaccacacccttgtctcatcttaatgagacaaggtagagccgag

SEQ ID NO: 94806 - DNA, 123 bp, Homo sapiens
gaaaataaatcaggtaatattggattttaattcattatatgaaatacatatctatgagtcctcggtgacatagatgattgaatcattaaactggggaagaaaagaaaaatcagtgcagaacaa

SEQ ID NO: 94807 - DNA, 455 bp, Homo sapiens
tgccccttgtttccacagctgaggcacagaaagtagcctcttttgtgaggagttgggagttaagtatacatttatttttttaccatgatttgttcaggaccacattttacaagataccttgtttcctttattattgtttctggaaagtcctattcatattattttatttgaatatagaatatagtttttttaaatgagggcttattttgaaaaattctgagcttaattcaaatttatgccaataccttcccaaataaggtaatagtcaaagacagatgttctgatcaaatggcttagagatagtcctggaatattcatattcaaagattccttattaatgaatgtctttaacttaaatctacccaataattgcaacatggttctttgtacattttcattatatggtgttaacaagcttcactgcaaacaaataaattacttaagttatttgttta

SEQ ID NO: 94808 - DNA, 318 bp, Homo sapiens
tagctaattaaccacagagatttgggaagaaatctattaaagagaccaaatacagtgtgaacaaaaagcaagtggtaatgttgccgcttattactgttatggccattaatattaatattaatgctattatttagttttattattactctgatacatcattattattgctgtctcctagcatcttcaccataaatctatcaccaaatgttttagaggtttaatattgttatagttatgtaattaaacaaatagaaataatcgttgcagaattgcagagttacataattattgctcctcaatggaaacgataaataaaac

SEQ ID NO: 94809 - DNA, 347 bp, Homo sapiens
aaaacctgatgttaattagcaagaccctcttaatttgattcttggtttatttctacttttcgtaagagtgaccatgatactccatataatatcctcagttctctggcatccttggtgatctgttttccagacctcatactggagagcaaatagctcttcttttcctcagctaatattgagtgctggggagtcacaaaccttgctgattggctctattaaaaatgcagtttttcattgctggttagtaattcttaatctcttttaagtttctcattataattactcaacttcccatgattttctttaaagagtattctatatgtgtattccattcggtaatttctttg

SEQ ID NO: 94810 - DNA, 459 bp, Homo sapiens
cttgtatatcaaaggcctgtgaaaatggctgattataaaggagaaagttaatgatctctaattgtgttgtaatgtaaatgcagtatcaccgtaatgaagagaacagatttgcatgttaacaaaagaaatattagaggagtgagtgtaggatgtttgggataattaattccatcctccactcctacatacatatgcatatacaaactcaattcaattttaaagagaacccgaagaaccaaaaatagactgaacacacttgatgttgtatgggagcttaaattactatttttgttgttctctgtgactatctcatttagtttctattgtgtttgcaatttcttccaaggtgatttttaatggattgagtaatgcataaaaatttgcagaagtatgcagaaagtttgtatgcagggccatgtagagcttttatcctacagtaaatcctagtagtttgctggt

SEQ ID NO: 94811 - DNA, 723 bp, Homo sapiens
ctggcgtacaacgccaagcgatccccctcctcagagagagcttacaccccatgctgctctccatcatcatcactgttgcagacaacctcaactccaagaactcagggatttacgctgctgccgtggctgtgctggatgcgatggttgagagcctggacaacctttgccttctaccagcgcttgctgggcgagtgcgtttcctgagtggccgtgcggtgctggatgtcacagatcgcctggcagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttctaaggttt

SEQ ID NO: 94812 - DNA, 395 bp, Homo sapiens
gaacaaaacattcaaaccaaatcagagagagaagtcaactgtgctaaaatcttccaagaaagcaaatagtatgaacacagagaggtgactgaagccagcctcataggggtaacaagaattctggacagaaatataattatcattaatcattaaacaggctgcactttggtccccttccttgtaactgaaagtcatgtagcagcacttgatactggctgtttgtatcctcatggttcctatagataggatttctgatgttggaatcataagagtttgggccaggcatgatggctcacacctgtaatcccagcactttgggaagccgaggtgggcagatcacttgagcccaggagttcaagaccagcctgggatacatggtgaaacccaatctctac

SEQ ID NO: 94813 - DNA, 806 bp, Homo sapiens
cgattctgccacttttttttttctctcaagaaagtttaaatttaagctcctgaaaaaagtcagtgtgcctacagataccactttattttgtccacttagatcagaactaggttgctatctttagcttaattctagcatatgagaaatgtgagatagttctatgaagactgtagtgaaaaaaaaaagattagaaatgtaaagtacaaggtgggaaattattgaaattgctattatttaacccaaagaagaaaaagtttgggcattattactttatagatgaggaaaggggaggctcagatggaggtaaagtaccttacccacagtcacccaagcactcggagtctcaatgggggcctgcactcagattagcctgccagtattgaagtctcaattcctcatctgctacaggagcctgatacatttgtgagtgacaagtatagtcgatactcattatttgcggattccatatttgcaaatttacctatttgctaaaatttatttttaacccaaaatcaatacttgtggttttatggtcattcacagtcatgcaagcagagcagcaaaaaaaaaaatgtgtttcctgacacgcgtgtttccagctgaggttgaacaaggcagtctctgccttttcttatactataaacaagtgtccttctgatggtcgattaagtgccacagttttttgtatttttgtgctttttgttgatcattttgctgtttaaagtgatcccaaagcatcgtgcaaaactgtttagtgtttacaagaaggctgtggtgtcttacagagaaaatgtgtgtttaaggta

SEQ ID NO: 94814 - DNA, 319 bp, Homo sapiens
tccccatgctcagttctcggggtacagagacaaatgaaacgcagtcttgccttcaaggaatttacaacctgttatcatctgattagtcagttgtttcaattgtgagttggtaaattgaatgaattgactccagaattttgaggtaggcatttctgtttttaaaaagtttcaggctgggcacaatgcctcccacctgtaaccctaatgcttttggaggctgagtcaggaagattgcctgagcccaggagtttgaggctacagtgagtaatgatggtgccacttactgcagcctgggcaacagagtcagaccattgtctct

SEQ ID NO: 94815 - DNA, 443 bp, Homo sapiens
tagctgccgtgggaaactgcttggcaacacttcaccaactttgccatgtgaactgaggtgtgcagccatggtcatgccaccctggagcatgtcaggtggtaacagaccctgcagtttatgctaggggcacctgttatccaggatggagctcatgctcatggaatagaagtatttttagaaaaaaattgtattgttagtttcattccataaacaggtaatactttttttggtagaaaacagaagtctcacagacatgcacatgcacatacaataaaaattcataattccaaaaaccagaggtaaattcttttaatattttggtgcaaatagcatcctagagtgtttgtatgtggatatagatgagtacaaaagacagcacagcttctgcttctggccaacatggaataacagggcctggatttactctcttgcctgggatagtc

SEQ ID NO: 94816 - DNA, 439 bp, Homo sapiens
agggaggcagagcacagagatgggtagaggaacctagttctgatgcaactggtaaattagctaattaagtatcaaatagacttttcagatacaagtttgcttaaaacagttttgagtggcttttctatccttgaatctgagagaatcttggcctctacaaaccatgtggtagggtgcttgtggttctcacttattttcacattggcgacaccttgggagttttttaaattacagatttaaaaacattcgtggaccgacgtgttcaatttcatatacagtgtgcatcatttcagggcttcagccattctgcgttctgttgtgaccatcgtcagaaagtgcctactacatgtgctgttgcatatgaagatactttataaagagagcttcatagacaactccagaattgtgtttaatctatttccaaattcttttacatcct

SEQ ID NO: 94817 - DNA, 426 bp, Homo sapiens
ttttttttggagacagagcctagctctcacccaggctggagtgcagtggcacgatcttggctcactgcaacctcctcttcccaggttcaagcaattctcctgcctcagcttccagagtagctgggactatcggcgcatgctgccatgcctggctaattttttttgttttagtagagatggggtttccctgtgttgccgaggctggtctccaactcctgaactcaggcaatccgcctgcctcggcctcccaaagtgctaggattacaggcgtgagccaccacagcccggcctagtctcaggctttctatgtgaagtcttttctgcatagcttgagtactccttctcagggagactgtctcaccatccgatttaaaatactagctccagcactccctgccctccccaccatctaatttttctccacat

SEQ ID NO: 94818 - DNA, 2293 bp, Homo sapiens
atcattttcatgttatagttatgcctgtgtggcctctgtcagaactattatcagtaaaagaggttaagcctatatatgaatgatggaccaaaaccttgaggttgtacattaactgaaatagtattttataaaatcttatggtgctgtggaaaatatttattatttcaccttttctgacacttcaccatggagactattcaggtaatacaattttaagtcattgcagttaatactctggttaattggtactgttaatcacccaggtcaggaattctgattttaggttatctcattaatcatggctgataaagaagctaaggggattctccagatctaatagatttcattagtcatttgtgtcgagtattcctccctaaaaacaaaagcagtattttctttctcaattaatttttaagttattcattaaaaaatatataacatcttaattttattcttttaaaaacatacagtgaagccttgctacaagagtcataagtgactggaatttcttgcataataggttcctccttttgaatagatcagattcatccccaggctctcagcagtgtcatgatgaaatgagtgtgctgacttccagggtgtggtggacactggtagctagccttatcagctccctccttattcctacctctgtcagcagcatgcctcgccccttacctaattctgctgtgactctgacagagaggaagtgccttctcactttgcaaaggaatgcagcatgtcacaaaggaggtgctccaattttttgtgtccttacttccctatgtttgcctagttactgaggctaggtcgagtgtgaagcaataggtgtaagatgctgagagcacatggacagctaccagggagatctgttgcttggttacagggtgtattcatgagtggtagctgcagttgtcgtgagagacatgcttggcatacagagctgtctaatgggtgggagacatgtaatggtagatttagggctgggagcatgattttgggtctgcccaaaggaacatggtgtcacttttgttctttctgacccactaaataaaaagtagtgtaacagggtttcactggaatgtttattagaaagtttacactttttatatttttatgattttaaaaacaaacaataatagaaaaacagattttaaggaacttcagagcagtatatattctgtctaaactcactgaatattttaagttgtaaatcaggtgtccaccaacctttatttttgcattgcaggagatgtgactgtaaagtagggagtttttttttttgagacagagtttcacccttgttgcccaggctagagtgtaatggtgcaatctccgctcactgcaacctctgcctcccaggttcaagcgattctcctgcctcagcctccctagtagctgggattacaggcatgcaccaccacacccggctaatttttttatatttttagtagagacaaggtttctccatgttggtcaggctggtctcgaactcccgacctcaggtgatctgcccgcctcagcctcccaaagtgctgggattacaggcgtgagccactgcgcccggccaaattattttggtgggtagattcattctctttacctaatagtcataatttagtcagtgaagggacaacatctggggtaagagctatggaggaggtgctcagctttgtgagttttgtgccaggcatctttgctgaaaatggagatggcagcaagtgtgaatctgggggaatataagggaagacagaaaagccttaagagtagacggaggaagaagggtaccagaatagtccctgtggaggcaggcagatcagagctcagggtttgaaagtgggcctgagtaagggtcctgctagagaaactgcagatggaagctgagcagttaccaactgctaatgtgccaagtataccaagcacagcatgtgtcctgtagaggagcattattttaaacaatgttctactatcatctaccaaaataattgtggtaaaagtgtagtattttattttttccttttatgtcagcaatattttaaaatattgatctgtttatcttatatttttatggataaatgtagtatttgcctcatgattgtgagccactgagagtgcactgaacctattcacatgtctttaagatgttttgctgtgttaaaattttaggagagaaaaatacaagtgaataattatttaataggcatttattactttattttggagttgaattctgtcatttgaaaaagttcagtaatgtaataaatacaaagtgatctgcactgttaaaagtcta

SEQ ID NO: 94819 - DNA, 954 bp, Homo sapiens
cggaggctgcgcggcggagagtagagagctagagggtgagaagcgctgggccggaccagaactgtcttagcttttccctctgcggctgctctggttggttactttgagcctgcctcctcagcgccgcaggagagacttaacagcaaaaatgactgtgtcctgagttcagcccccactgctctgggagcttccccctggtttctgcacctgaagaatgtcatcccagccgaagttcttaggagcggggagcacaaagaaaaacaaagaaaagcagacctgaaaattgggacctgggagaaatagacgagtgctctaaaccagtatcatggctccagttcctctgacaaggattcacatggggttgcaattctgactgtgctggtgatgctggttccaggtccctcaggaacccctcccccagtctggtctgcccttgaactctatactggccccagggtatcccaggattgtcagaaaggcctggccaggattcacctgggagagggatcagcatctctgcaaagttgttggattgaaagaactttcattttgagctacatcattgaagagctttaaatctgaaaataagaaagacgttgaaccctattactcacatctctttgtcatttgaagcagatcccgaaccactcaaaaggacaaaacaaggaaatagcaatgaaattggattcagtgaatggggtaagggtattaagtgtctgaaatataagagataaaaaaattagtttttacctttttttctattttctaaatgttttggtggctagaataagatatactttgaactcaagagcaataaatgttaatatattaaaagtagctttatgaaatatggaaagtatctttatttcaaaatacttcaaagtaatcatctgaatatttatcagaaatattaagacaacttattaaatcctgtattaaaatgattgcttatta

SEQ ID NO: 94820 - DNA, 1040 bp, Homo sapiens
cggaggctgcgcggcggagagtagagagctagagggtgagaagcgctgggccggaccagaactgtcttagcttttccctctgcggctgctctggttggttactttgagcctgcctcctcagcgccgcaggagagacttaacagcaaaaatgactgtgtcctgagttcagcccccactgctctgggagcttccccctggtttctgcacctgaagaatgtcatcccagccgaagttcttaggagcggggagcacaaagaaaaacaaagaaaagcagacctgaaaattgggacctgggagaaatgggaactcaaaccaaaaacaggaatcatccttgctaattagtgctgagtggatcagggactaaccagaatcaggcaacaagaaaatagacgagtgctctaaaccagtatcatggctccagttcctctgacaaggattcacatggggttgcaattctgactgtgctggtgatgctggttccaggtccctcaggaacccctcccccagtctggtctgcccttgaactctatactggccccagggtatcccaggattgtcagaaaggcctggccaggattcacctgggagagggatcagcatctctgcaaagttgttggattgaaagaactttcattttgagctacatcattgaagagctttaaatctgaaaataagaaagacgttgaaccctattactcacatctctttgtcatttgaagcagatcccgaaccactcaaaaggacaaaacaaggaaatagcaatgaaattggattcagtgaatggggtaagggtattaagtgtctgaaatataagagataaaaaaattagtttttacctttttttctattttctaaatgttttggtggctagaataagatatactttgaactcaagagcaataaatgttaatatattaaaagtagctttatgaaatatggaaagtatctttatttcaaaatacttcaaagtaatcatctgaatatttatcagaaatattaagacaacttattaaatcctgtattaaaatgattgcttatta

SEQ ID NO: 94821 - DNA, 991 bp, Homo sapiens
actctacatcctcccacaatgatactagacagacacactggcacacctcgaaatttctgggttgtgcacagcccaagagggctcatttaagctgccatgtccactcctccaacaaatccaggcaccatctaaagggaacatgccaagtcacagtctcctttgtgaattccataatggcaagagagctctcattcatatttgcgttcctggcacccagagcacatttaataaaagttgattaaacaaaaataatgacttggtcctgaactgcattctacaactgctccttgagttttgtcccatcctataataaccatcacaagctctgctatttattctaccatttctgtcctggccccacctttgagattgttctcacagttatctttgccactaggttgcaattctgactgtgctggtgatgctggttccaggtccctcaggaacccctcccccagtctggtctgcccttgaactctatactggccccagggtatcccaggattgtcagaaaggcctggccaggattcacctgggagagggatcagcatctctgcaaagttgttggattgaaagaactttcattttgagctacatcattgaagagctttaaatctgaaaataagaaagacgttgaaccctattactcacatctctttgtcatttgaagcagatcccgaaccactcaaaaggacaaaacaaggaaatagcaatgaaattggattcagtgaatggggtaagggtattaagtgtctgaaatataagagataaaaaaattagtttttacctttttttctattttctaaatgttttggtggctagaataagatatactttgaactcaagagcaataaatgttaatatattaaaagtagctttatgaaatatggaaagtatctttatttcaaaatacttcaaagtaatcatctgaatatttatcagaaatattaagacaacttattaaatcctgtattaaaatgattgcttatta

SEQ ID NO: 94822 - DNA, 1052 bp, Homo sapiens
cggaggctgcgcggcggagagtagagagctagagggtgagaagcgctgggccggaccagaactgtcttagcttttccctctgcggctgctctggttggttactttgagcctgcctcctcagcgccgcaggagagacttaacagcaaaaatgactgtgtcctgagttcagcccccactgctctgggagcttccccctggtttctgcacctgaagaatgtcatcccagccgaagttcttaggagcggggagcacaaagaaaaacaaagaaaagcagacctgaaaattgggacctgggagaaatgttggagtgcagtggcaccacctcagcttattgcaacctccacctcccgggttcaagcaattctcctgcctcagcctcccaagttgctgggactacagagacgagtgctctaaaccagtatcatggctccagttcctctgacaaggattcacatggggttgcaattctgactgtgctggtgatgctggttccaggtccctcaggaacccctcccccagtctggtctgcccttgaactctatactggccccagggtatcccaggattgtcagaaaggcctggccaggattcacctgggagagggatcagcatctctgcaaagttgttggattgaaagaactttcattttgagctacatcattgaagagctttaaatctgaaaataagaaagacgttgaaccctattactcacatctctttgtcatttgaagcagatcccgaaccactcaaaaggacaaaacaaggaaatagcaatgaaattggattcagtgaatggggtaagggtattaagtgtctgaaatataagagataaaaaaattagtttttacctttttttctattttctaaatgttttggtggctagaataagatatactttgaactcaagagcaataaatgttaatatattaaaagtagctttatgaaatatggaaagtatctttatttcaaaatacttcaaagtaatcatctgaatatttatcagaaatattaagacaacttattaaatcctgtattaaaatgattgcttatta

SEQ ID NO: 94823 - DNA, 911 bp, Homo sapiens
agcggctgggagggacgcccagggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccaggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagttgggagattcatcaagtactttgttaaagggcgccaggctgtccttagcatggtccggaaggccaaagtacccgggaactggtcctatcagagctcctgggccggcgggcgcctgtcgtggtgcggttggcctcacctaccatgtgcacgacctccttggggcccgctatggactgctctctacccttcaggaacctcctccgctgccaagactgaaatctgccctcctggtccgccta

SEQ ID NO: 94824 - DNA, 406 bp, Homo sapiens
ccgggaactcgcccccacccaccctgctcgcctcctcaccgtgcaccctggccacagcagcccctccagtggggccccaggaactcaatggatggggctcagccttccgttgtccacagttctaggagaaaaaacacaatgtggccagcagaggtgatggctcactgctgctgatggcagccctgcattcaaaaataacaccaggtgttgtcactgcatagagaagcaggttggaccccacctgtccacagggcatttccctggttctcaatgtttagcttgctgttaggctgggcggtgtggctcacgcctgtaatcccagcattttgggaggctgaggcaggcggatcacctgaggttaggagttcaagaccagcctggccaacatggtgcaaccccatctcta

SEQ ID NO: 94825 - DNA, 612 bp, Homo sapiens
aaaaaaaaagagtcattgtgacatacacaatacaaataggtatatagtaatttgttaaaaccattagatcatgttcatataagcttggaacttatttaatgtctccaatgttgtgatggcttgcttttataatttatgattggttttgttatcaaaaaatcacagtttgaactgagagtgaaagtagaccaacgactccttttttcttatctctcatcttgctgtctgaagaactgttgaagcctccttgagatggctcttgtctgtcttgcatgtaggatgtaccttgtaactattgaagtgtccaattgagagtgttcaagagtcagtcaagaactgtccatctggctagagattttgtttttcatccacttcaagtcagtgccttttcctgttggtgttttccatagttattattgcccccttgttctgataggtcatatgtcacatatctctgagacatcataggtcagccatgtggagcctaccgaacaagtgtttgtgtcttaggacctgttgaagagggataggcgtggtgttcgagcagtttctctttcagctgggcttatttctgtcctgttacccactctgttcacatttatatgaaaaaaa

SEQ ID NO: 94826 - DNA, 488 bp, Homo sapiens
cctcaggtgatccaccagcctgagcctctcaaagtgctgggattacaggtgtgagccatagcgcctggccccattaagggaaatttagatgttccattttatttttatatcaatgataaattccccaagggtaataactgtatcatggttattaggagaatacccttaagctgaggacatacatacttaagtatctaggggtaaagaggcatgatgtctgcaatttattctcaaatggttcagcaaaaaagcataaagcatgtgtatgtgagagagagagagagagagaggaatagggatggatggagagggaaaaataaagcaaatacggcaaagtaactcataaaaatcttcctataactagaactattctattctttaaaaaaatacaaaaatctcatacaaaatatgctactatatgcagagcttcctaatggggtctgacacccgtggtacccttcatgtaatgatttttgttcttctgatag

SEQ ID NO: 94827 - DNA, 137 bp, Homo sapiens
aacatggagaacattcaaacacaatatgggggaggaggcgacctgcgtgacttttaacatccccttcatatcctcccactgggcgcattttaagcgccagcgctcaccacatccggctgccccaccgcccgcgcccg

SEQ ID NO: 94828 - DNA, 520 bp, Homo sapiens
gagatattttgaataatactcgaaagtgattacagcatattagacataaaattatttttaaaataccacctttactcagcactagaaatgagagtaaaacccacagaaaactgtctacactatgcgggtgctgttaagggtgaaaagtagcacatgaagaactcacacctgaatttctaaataccttgctaggaactggaaatggggtagaaattaaaagagaagtgggagcttataggactctcttcctggcttcacagtggagggggttcccaattctgtggaagaccagcctctcttcttcagttctggatatcatctcccattcctatttctcaagagcccctctcctttagctctttactggaatatttccatgcttttattatgttatatttattatatgatcacaccaagcaataataacatttaatccctatattgcaccccattgaaaaatcaactcaaatggatcaaagacttaaatataagacctggatctataaaactactagaggaa

SEQ ID NO: 94829 - DNA, 626 bp, Homo sapiens
cccgtccttttcgctctcatctttgggcgctttgtgcagctgccttctttgtctccgcctctccggcgactgggctctcccttccctccctctcctccctcccccagtgtcaagaagccatcggcctcaagggcatcgatatttcagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtggtgagcccgggggcacggcccaggtgacatggggtgaagccacctgcgggtgcgtggatcttaggaagaggaggatgagagcttctccccagccttcctctggaggctgcggaaatagagcctgctttgggaccaaagtgcagggcgtgcagtgcggatccag

SEQ ID NO: 94830 - DNA, 653 bp, Homo sapiens
cgacgttagagtcgggctccgacagcgcggccgagtccccgcgcgtcatcctcctttgactcttgggggctccaaagggacctctctcttggcaccgggggtgtctgcgcccgccgcccgccccgcttggctttgcggcatctcggccctggctccagctccggctccggcgagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtggtgagcccgggggcacggcccaggtgacatggggtgaagccacctgcgggtgcgtggatcttaggaagaggaggatgagagcttctccccagccttcctctggaggctgcggaaatagagcctgctttgggaccaaagtgcagggcgtgcagtgcggatccag

SEQ ID NO: 94831 - DNA, 464 bp, Homo sapiens
cccagtcatatactgttgatagaaatgttgagtcctttgcctatcttttaatcaggttgttttttagctattgagttttttgagttccttacatattttggatattaactccctatcagatgttttgattgcaaatattttatcctaatttgcatattatttcttcatcctattaactgcttcctttgctgtgcaaaacttgtaagtttgatataattccctttgtctatttttgcttttgttgcttgatcttttagaatcaaatccaaaaaaataattgcccagaccagtgtcatgtggtgttttcctatgctttcttctagtgcagttactgtttcaggtcttaggtttaagactttaatccattttgagttgacttttgtaacgaatatgagataaaaggataaaggttgtttcatgtttctgcatgtggatatccagttttctcaacactctttattaaa

SEQ ID NO: 94832 - DNA, 81 bp, Homo sapiens
ctcaaattcatttcatggtggaaaacaactgacagccccagcagtctctatccttgagcctgcagtggccttcaatgaatg

SEQ ID NO: 94833 - DNA, 3536 bp, Homo sapiens
cggctcaagtgaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggttcctgcttgaacaccttcactaagaacccttatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaaccccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagagagagtgagtctccatctcaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaa

SEQ ID NO: 94834 - DNA, 1367 bp, Homo sapiens
cggctcaagtgaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggtaaaatgtggaaactcaccttctctcctcctgggactgaagccatttatccaaggtttagctgaaaggcccattgttccagggaatctgcctttttccgatctccaccccaccacctcccagaatgatggctctgaggatggtatgacattaccctgaatggtcttcagaatccattcctgagatcaccagtagctggtgggcccagaacatgggttcgagcttagtacatacatgaacaagctgtgcttcactgtacgagtgtgttcacctttccagctcagggccctcacatgtgaaatgtttggactagaggatctccagggtcacttccaatttcattgtattttgattatgactattggagagtcattgagaaacatatactaatcctgtactccatggttgtcactatgtccctctgaatccctctggatcattctgtagttgtgccattctccattcagaaaacctgatcttagaccctcaaggaatcattataccctccgattcacccaca

SEQ ID NO: 94835 - DNA, 3031 bp, Homo sapiens
gttaaaaaactaagaccgtgacatggaaagtcaactagccatgcaagacagtcagtggtaagtgtcagaaacatgaagggagatcctgggtagaagagctacatttgactggccacacagggaggggttggggaaattgtctttggcctaatctggactctagagtagaagagaattcccattgacctgtgggtgaggcctcagccaagtgactcctgagacattctgaggatccaagcatccatttcaaaggatggcagccatttaatccctgggggcttcctttcttcatcttaaaaagagaacattggaatagatcattgctaaaaaaaccacctttcacagactgtgggtctatatttatttgtgagacagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaaccccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagagagagtgagtctccatctcaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaa

SEQ ID NO: 94836 - DNA, 3467 bp, Homo sapiens
cggctcaagtgaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggtaaaatgtggaaactcaccttctctcctcctgggactgaagccatttatccaaggtttagctgaaaggcccattgttccagggaatctgcctttttccgatctccaccccaccacctcccagaatgatggctctgaggatggtatgacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaaccccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagagagagtgagtctccatctcaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaa

SEQ ID NO: 94837 - DNA, 572 bp, Homo sapiens
ctttgctgaattggataatggtttccaaataccagaagaatacttcctattttttgtgctattcacaatgtaatggctacagatattatacaattttaagtttcatctgcattcctccattgctatcttaagtctagagcaacaatcatcaaaacagtaaatcgagtcctagcttatagcaattgcaaatttctgtggggtaatactcctaccatggctgattttaagacatgcagaattagaaagacagatactctgttaacaaaggacagatacaatagatgtagataacctcgagagcatagacagcaggaaaatgtcaaaaaaaggattagaaagtgatgagttttgaggatttattatctttatttttaacataatttatttaattatgtttttataatttaatttttaatgatggcttgcaaatttctgagaatttaacaattggctcccacaaactagtacaagccagctccagctcactattggctcatgtgtttgcccccacaggtcggcttgggaaaccaaaaattacacagagtttaatggcatctgtgaacagcacctgt

SEQ ID NO: 94838 - DNA, 3485 bp, Homo sapiens
cggctcaagtgaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaaccccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagagagagtgagtctccatctcaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaa

SEQ ID NO: 94839 - DNA, 3387 bp, Homo sapiens
cggctcaagtgaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaaccccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagagagagtgagtctccatctcaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaa

SEQ ID NO: 94840 - DNA, 857 bp, Homo sapiens
cggctcaagtgaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcaggtaaccagctctgcccatctctcctggtgagtctcagagatcactctgaggagctgcaaggtctgaacgtgggccacattctctagggagatgtgcttcctttatctttgcctggtcactgagggcatcacctcccaagaagcctact

SEQ ID NO: 94841 - DNA, 338 bp, Homo sapiens
aaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaa

SEQ ID NO: 94842 - DNA, 389 bp, Homo sapiens
ccacaaattatttacattcctcccacatgcaaaaatacactcagtcccaccaaaggtctcccaaagtctcatcccattatggcgtcaggatgaggtccaggaactcatcatttaaaccaggtccaggtgtggaggaaattcctcaggtgtaattcctcaaatacaattctcagtatgaagacctgtgagctagagacaagttatctgccacacacacaaccccaatgtccaatgcagtacagtcataggaaaaccactacagatatttttgttcaaaagaggtggaagggggagacaaaaaaaaaagtcactggtccttagaaaatcagaactttagctgggaaaatgttggaaattccttgattcagacactgctcaactcctaccta

SEQ ID NO: 94843 - DNA, 816 bp, Homo sapiens
cctcttccacagtgttgaaataaggttggaaagtttcatttttctatctcaactttatactttgaaaaaaaaaaattccaaacctacagactagccaaaggaataagaaaatgaacaactgcatctctctcacccagattcactaattgtgaatgttttgccacatttatgcttttttctgcaacacactttttcttaaaagccagctgtttaagttgcagataattgacacttcaactctgactacttaacctttgtatctatatagaacaagatattaaacattggtacaatagtgttatttaaaatgtagccacattaacactctccccagttgttaccaaattgttcttttttgcttttaaaaaatccaggatgtaatctaggatagttttattgtgtttggttgttatatctctttagtctcctttgatccagaagagcatgcccagtttttgtctttcgtgacattggcatttttgaagcgtccaggcctgttttcttgtcatacgtctcctagtcttgttttgcctgattgtttccataggttgtggtgtagtggtgcatgttcgtgttcgcatttcctcttgcattgcttctgtttgtcccatccttggtgatgctcagtctggatgcctgttgggagtagggcctgccagtctgtccattgggaaggtgcttggcaggtgtaattgctcaggactgtagagaaagtgggcgaggtcaagagttggacttgggtctgaatggctccagctcctgtgttctgcaccactttgctgcattgcctctttcttcttgaaaacaaaaaaaaaa

SEQ ID NO: 94844 - DNA, 385 bp, Homo sapiens
ccacagagagtatctgttccctgatatcttatctgatgtgcattcaaaccaagtttcaaaaacttttcaaagtcatcattctcttcactacaaattaagtttgctaacaatattgccatttttttttccttaggaatgaaaagaatgtctgtgcttattaaagggagacaaaactcttggcccgggccccacatgggccactttgtgagttatgttggagggagaacaggcctcatctccaccctacaaccaaaccaataccaggtaaggcaggagggcgtttctcaaggataagagcgacacggcctgacagtcactagtattcatttttcacaattgcctaagtgattttcttcttatttgagctgagggtctctatgtgtga

SEQ ID NO: 94845 - DNA, 153 bp, Homo sapiens
tccagcattccagcagttctgaaggtcctgtgcctggcctcacaagcccattacaggttgcaaagatctaatgatcttctcagaaggaaactgaggagacaggaggcactgagaagctgcacaagcagcacttgcgtgattctcagagagtac

SEQ ID NO: 94846 - DNA, 599 bp, Homo sapiens
gcttaagtgattcagttcatgtcaaacaacatttcacaggattcttacccccaaggcaactctttactatccagtacataagactctagaacattaaaattctttatatagtgccatgtggcatctaaaataactttggctaggaaataaaacatatttgcagaaagtttggggttgaaatcaaagaatggatcaaagtggcccttcatttggctccacgtcatctcacaatagtgaaatacagcagaatgtcactaaactaccataaaactaaggggagagactttgcaaaaacagggagtgacagacacgttttttgctcctgttttaaagtaaattgtactaatgacaacaatagtgatcttttataggcccaagttggatcagtgatcaatttatagcatttctgtttcaaatattcaaaagcaaaaagtaatctgccaattagaaaacaaaaaacttcaaacttaagtgatgtaatgatggagcacctgtatttgactagatgttatatacatgccattgaaagacatagtacctaatctgcctaatgtctataaactggtgcaaataaaagacatttaaaccatgaaatctct

SEQ ID NO: 94847 - DNA, 329 bp, Homo sapiens
gcttaagtgattcagttcatgtcaaacaacatttcacaggattcttacccccaaggcaactctttactatccagtacataagactctagaacattaaaattctttatatagtgccatgtggcatctaaaataactttggctaggaaataaaacatatttgcagaaagtttggggttgaaatcaaagaatggatcaaagtggcccttcatttggctccacgtcatctcacaatagtgaaatacagcagaatgtcactaaactaccataaaactaagggatcaagccttaagcgtgatcagcgggtatactctagagtcagactagcagac

SEQ ID NO: 94848 - DNA, 425 bp, Homo sapiens
ggcccttttagtgacctgcagggactgtagctaggtagctgacgtcgtataacagacgatagcgactgagaacagttagaatggcaatcattaaaaagtcaggaaacaacaggtgctggagaggatgtggagaaataggaacacttttacactgttggtgggactgtaaactagttgctatatgttataataagccatttgtactttaaaaatactgtgagcatagtattattattataatcattattatcatcaaaggagaggacctctagtgaatttatgttgatatgcccatgtagcacagaaccatacaaactttgctagcaaaaatagcctacccttttgaaactgtttcccatgcttggggtatagaatggaaaggggtcactgccctggggttgctgatatcacatagtagccacagc

SEQ ID NO: 94849 - DNA, 208 bp, Homo sapiens
aagatagtgccattgcactccagcctgggtgacaagagtgaaattctgtctcaaaacaaaaaacaaacaaaaaacaaaacaaaacaaaaaacaactcagccacctctgcccacacaattcctaatagcacgagctagctgtctctatagaggtccatcctgctgttaaatagcccggaccattgccaaattcctcctgagtgcaaatg

SEQ ID NO: 94850 - DNA, 342 bp, Homo sapiens
cccgactagcccgacgccaaaaaaaatcctaagcaaaaagaacaaagctgaaggcatcatattacccaacttcaaactatactacaaggctacagtaacccaaacagcatggtactggtacaaaacagacacataaatattgatactaataatgatctatttacctatgtgtataaatgccagtaagtaaaaagtgctataaagaaaaataaagcaagctgaaggattagagactgaaggttattatgcctttttttttttttttttttttgggggcaaggggtcaggggggggttcctgtggaaggggggaatatttcccaaaagcccagggggattcaaa

SEQ ID NO: 94851 - DNA, 692 bp, Homo sapiens
aacagtcccaaaaggggcattagaaatcctggcgttttgctgatgttctgcttcttgatgtagatgcttatactgtagagcacatctcttcaaggagaactacaaaccactgctcaacgaaataaaagaggacacaaacaaatggaagaacatttcatgctcatggacagaaagaatcaatatcgtgaaaatggccatactaccctaggtaatttatagattcaatgccatccccatcaagctaccaatgactttcttcacagaataggaaaaaactactttaaagttcatatggaatcaaaaaagagcccgcattgccaagataatcctaagccaaaagaacaaagctggaggcatcatgctacctgacctcgaactatactacaaggctacagtaaccaaaacagcatggtactggtaccaaaacagagatatagaccaatggaactcaacagagccctcagaagtaataccacacatctacaaccatctcatctttgacaaacctgacaaaaacaagaaatggggaaaggattccctatttaataaatggtgctgggaaaactggctagccatacgtagaaatctaaaattggatgccttgcttacaccttatacaaaaattaattcaagatggcttaaagacttaaatgttagacctaaaaccataaaaaccctagaagaaaacctag

SEQ ID NO: 94852 - DNA, 680 bp, Homo sapiens
atcatgagatgcagaccacatggagaccttaatgcatggagatcttgcccactagtagcgtggcccagcgttttgggacacagcccaatcagaccagtatttcccctctggagctggattgaggagggaacatggggactgaaaccttgaatgcttctgctttaattaccccgaaaagctagtgccactggttagaacatggaagatcaggcctagctgtctgggcgcggcatcgtcagtcacggaatgctaacatgtcctatgtacccctcatgatccacacaaagaccttctgagccttgtgaatttaacgtagagggatgactgctattgcttcattcctgtgccctctgagtgggacgactgtgcctagagtgctgctgtgccattggtgacccgcctctgccatgagatgccatgccctggaactggacctgccttctctcccatcttcctcatggttgggcatgggtctcctccacttttgctcagcccgagcaggcaagccccgcttgtcctcagaagcatggggtcaatttgtcacattccagaggagagcccgccgcagggtttcaatcacctggtggtgggatgatgaggacaggacacatttacttgggggccgtcaatcggatttacaagctctccagcgacctgaaggtcttggtgacgcatgagac

SEQ ID NO: 94853 - DNA, 201 bp, Homo sapiens
ttagcagctctgagatgggaaatttgttgtccctttgattggccccacgaagagcccgagtgaagaagcagatgtcaaatgatttgctttattataaatgacctggagagatacctggcaaagtcatcaccaagttctttctcaagttgctctgcagctcaagaaaagagctggccaggcacggtggctcacacctataat

SEQ ID NO: 94854 - DNA, 425 bp, Homo sapiens
aatgccaggatgctctttagtttctgctgactctaggagaagtggtcaggcctgccctaacattggcagggcccagggaaagattacaaatggagacccatgtgttacaggtcacatttagaagttagaaatcaagctaataaaccattaaataaaagatgtttttgttcttcttccttgacaaagtaggccttcaaaatgacctggaaggccaggatggactttagaattcttgacttcttagggttccacaccacggtattgtagttggaagagcctcccccagcctttccccttttctcccactcctatctccatctcaaggggccttgcacacctgcttgcgagcaatgcggcgtgcatgtccatgctctgtacatgcatacaatcacatgcacacatacacaaccaataacagttccagg

SEQ ID NO: 94855 - DNA, 459 bp, Homo sapiens
acagtctttgtggtccatttagcaaatacttctatgtacctgtccttgttgtttctaagtcttttcaccaaccattccatccttctctactgagtaaggtttagtggtccacacccacttccctaccagctgccccagcatgtaaggataattggcctactgcttttgaaaggtttctgatatctatccctggccccgcatccttatagaatccaaataagggcaagataacccctgattcccagtgggggtggaaagtaggtcagtgctgctgtctggccaagtctcgaggatggtgtttaaggcctgactatagaaaactctgtgattattgtccaggggcaatatatgcatgacctcggttccaaggcagttcatagtatcccagtccctgtcagttctttcccctactgagaaaaaaatcatgggatcaggtgtctggaacctggtttgatatgg

SEQ ID NO: 94856 - DNA, 272 bp, Homo sapiens
ggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctagg

SEQ ID NO: 94857 - DNA, 443 bp, Homo sapiens
tacccccgactagccgacagtcccgactagcgacaggcctgatagcccgacagtccccgactagccgacagtccccgactagccggagagtccccgattagcccgacagtccccgactagccctacagccacaaattacttgatattcttctgtgtagacggaactcacttctagtgaatagaaagtggtggaagtgacaatgtgtgacatctgagactaggtcataaaagacattgtcacttctgccttgctcttttttggatcacttactctagaggaagccacctatcactgaaaaacactcaagcagcctaaagaggagaccacatgagaaagtaccaagacctctcattaacaaccagcactgaggctgggtgtggtggctcatgcctgtaatcccagcactttgggaggccgaggtgcatggatcacctgaattcag

SEQ ID NO: 94858 - DNA, 569 bp, Homo sapiens
tcgagctcggtaccgtcacgcccacaggactcacggatatgatcaagggaaatacatgaaatacacatcatcttctcaatgctatggtcaccctttacactctgctgtctttataaatttcttgtcaaaattattcattttacgtgtttaactctgaggaaactgagtctcactctgtcacccaggctggagttaacctccacctcttgggttcaagcaaccttctgcctcctgggttcaagcgattcttctgcttcagcctcccgagtagctgggattacagatgcgtgccaccacgcctggctcatttttgtatttttagtagagatgaggtttcgccgtgttggccaggctgaggtgtatgccttttaaaaataacacttgttggcacttgatgagccttttagacttaaaaacttaaagtcttttttctgttcaaggttgttttattgcttccctttctttttttttccaacctccttactttatagaactcagaaaggtgaagtgacttgtccaagctcatatagctagttacagatgaacctcaagcaaataacctgactcct

SEQ ID NO: 94859 - DNA, 283 bp, Homo sapiens
gtaagtgtgcccaggggtctcaggggggcgttgccagggctctcagctctcctccctgtggttctcccaggcccagcccctgcagaacctctgcttgttgtggttctgccagacagggtgagccagggacttcctgaggtgccccctgcagcaggaagctccttttggacaggcgtgtctcggacccacagtctcccccgaatgcggagtccagcctaagccttcccctagaaggtgtctggtagatgttgagtgaggtttcaggagcagggccaaggctggg

SEQ ID NO: 94860 - DNA, 626 bp, Homo sapiens
ggtcagggttcaaactaccacacctactaccacaagtatttaaaacctgtgaactggaagtggggcgccaccaggcaatggctgagatgcagaggaagaagtgtttacacacctggagcattctcactgtagctctttccaggaatgagttctcctgtctggctctgggcccaaagccttctccctagtgggccatccctcagcctggtcttagaaaatgcaggcactgccctgctccttggtgtgggatgactgaaagagcactggacttggagtgactttacacaagactaattaacctctccgaggaccagcttcctcacatggaaaagaggaatagcacactcctcactgccgccgggggtgaataaggttggtgctaagagtgctttataaactgtaaaggactgtgcaaatgtatattctagtgaactcattttagggtataaattatgtaaccaagagatggttcacagtagaagggtcttgaggccccatctttctttctttcttttttatttttttgagacagagtctcactctgtcaccccagctggagtgcagtggtgcaatcttggctgactgcaacctccacctcccaggttcaagcgattctcctgcctcag

SEQ ID NO: 94861 - DNA, 492 bp, Homo sapiens
agtggtttgtgttgaatgtaaacataatgagggaataggttgaagtctgtacccactccctccgtctcccgttcgacaaaccccaaacgcctgtctgtctcctcctccctgaaatcaggaagggatcttttgatttcttctctgttcttttccctaatgtgtctttagcagtgatcattggagtattacaatctcactgcctggtttagcatagaccctggggcctggagggaagtcagaccggacatcagtgccccaactgaataatctgtgtcactagggctttgagccaaggatgtgagcggaggcaattcccggttttggaagaaaatcagacaggaaaccagtgctaggaagaaggaagagaactcagtccagcagagtgtaatagggcctcattaccgaagcaaaaagcagctgttggctaattcctagcatgctgtaacacatgagtattttgcaattagcaataaccagtgcacggggtttcgc

SEQ ID NO: 94862 - DNA, 521 bp, Homo sapiens
ccactcccttcccatatctgtccccatttattcagcactttattgtgccagagctgagctacgaatcacctcatcatcgcttttcactcccggctctacgtgggaactactataatcctgcccatgttacatgtgaggaaactgcctgaggcctcgcagacagggaggagtggagctgggatccaaactcagctttgaccctggaatctatgccccgccctctggaacacaccagcaaattctccagaaagcgccgggaccttagcactgggcttttccaaagggatgattttccaaagggatgggctgccctggccagatgggcaactgcctcctactttctagctctgcccagtcctgggcagtaagattcccgtttccagccgggcacagtggctcatgcctgtaatcccagcactttgggaggccaaagcaggcagatcacctgaagtcaggagttcgagatcagcctggccaacatggcaaaaccccgtctctactaaaaatacaaaaattagcaa

SEQ ID NO: 94863 - DNA, 391 bp, Homo sapiens
gctttttttttgcatttaagagcatctagactgaaacttgggatattttgctaaatgttgtccaaggaattttcagttggctagataagaatagtggtatataaatgttgccactaagggtttttagtatttaaaaataccatttgctttcgttgtgtgccacaacctctcccactttccacccccaggcctgtaacactttttaaaatactatcatgtttgttttctgtaacagtgttacttaagtaaaggtaagttttattttagctgttgaaaaaataaattctggctggacgcagtggctcacgcctgtaatcccagcactttgggaggccgaggtaggtggatcgcttgagtccaggagttcgagagcagcctgggcaacatggta

SEQ ID NO: 94864 - DNA, 798 bp, Homo sapiens
aacaagcgtttcaaatttaagaaggttaaaattatgtcaagtttttattctgactataatggtataaaactggaaaccaatagcaagaagaaaattggaaaactcacaaatatgtggatattaaacaacatgctcctaaacaaccaatggggttcaaagaagaagtcaaaagggaaaaaggaaagcaccccaatacaaataaaattgagcacacaaggatccaaaatttctgggatacaacaaaagcagttctaagagaagtttataataataaactcctacactaataaaaaaagaaagatttaagtaaacaacctaactttaactcccaaaaaacttgaacaagaccaaaataattccaacgttagcttaattataaaaatatcaagaattagagaaaaaagaaagtaaacagagactagaaagacaatagaaatttttttttaattgagctgaggttttaaagaaccaaaattgacaaacttttggctatattaacccagggaacaaaaagagagaggacttaaaaaaattataaataaaaaattaagttatttcaaaagatcccacagaaatgcaaaagataataagagactactatgagcaattatatgacaacaaatttgataactcaagaaataattattagaaacaaacccaccaagattaaattataaaaaaaaagaaataccgaacagatcaataatgaggaaggagattgaagcagtaaccaaatacttccaattttgaaaaatcccatgaccggccgggcgtggtggctcaagcctgtaatcctag

SEQ ID NO: 94865 - DNA, 228 bp, Homo sapiens
cagtgccccactatcccacatgcagcctgaacctctattatctctcttaccatacttcccactcttctagctattcactgcctctgctctaatcactgcttttctttgaatacatcacgcacagtcttgctgtatggtctttgcacaaactgtgccctccgtctgaacggctcctccaaaaatagctgcctggctaactccaacatctttctcaactattgctttcca

SEQ ID NO: 94866 - DNA, 483 bp, Homo sapiens
agaaagcaagcaagcaaccagccatggaaagtagataaggttgttaggcttaagattatcacatttttaaagcagaggaaaccttaaaagagagaggtgaaaaggcttgagtcatagacatggggttctgcctgaatgtgctctttctgctgccccatgctgctttatactttgaagatcctgaatacattctttgctgaatgctaaagctgtgttagcttggggagggccctgtggatctttgtatgtgcggttgcttctttaatctttgggctggtgatagcttggcagagaggccttgctttcccttgccttggtaggagtttgtcctctgtggggccatacctttggcctgccttttcctcttccaaagtcctgctgagactttggaagcctaagacgtgtgaacgctttggatgattctgagagttcaagccaacctgccctgtggccttctcgtgactttgttaggactgaggcatc

SEQ ID NO: 94867 - DNA, 317 bp, Homo sapiens
atccgccgcctcagcctcccaaagtgctgggattacaggggtgagccaccgcacccagttgttatttttgttttaaagtcacacgagacataaaagcttaagaaacattccttccttctgtaactattatacaggcacctactatgtgccaaacactacgctaagctatggaatacataggttcttttctccagggacttacctgccatccagtgaagaagtggagatgtttgagtaaataatgacattcactttctaagagctgttataaagatatacacaaggggcagcagaggaattgctaaattgcctggaga

SEQ ID NO: 94868 - DNA, 372 bp, Homo sapiens
caaaaagctggttttctacataattcagagttctcacaaaccacctatttgttttctctctctgctcaagaccccaaaatggtggctgtgtggcctgttctttggttggaaattaagttcttcttctaattctggttaaaccatgtagctaaactgaaaacaaactttttcacctagattacctcagttggcctttttttctccccctatttctacacataaatatatcattaaaatgctaatttttatcatttgttcttctctaataaacacgtgagaaaaggaatataatttttaagcgggaagatctttgacaacaagaagtctgtattataaactaccaatatgctgaaaacacaataccagcaatgt

SEQ ID NO: 94869 - DNA, 641 bp, Homo sapiens
tttcttgtagagatggggtttcatcatgttgcccaggctggtctcgaactccagagcttaagcgatccactggcctcagcctccccaagtgatgggattataggtgtgagcgaccacacccagcccctggtcactttttacagttaggtatcactagagagactaaatacccaacaggaaacatttttctcatttctattttcccatgatagataccgatcctgggggagtgggctggggagggtgatgggattatccagtgaaaagccgcaggcaacagttcaagtccctctgaatccacagctacatgcacagcttcagagcaatacaaaacaggtaatttaattccataaaattatctttctacagttcgttttttcctcctagcctactgaaatgtacacaccatgagtacaaagtacaaggtgctgttcagctgtaattttacttctgcacatatttaatgtgctaatgggatgaagcatttcatggttcctgtgcttagcaaatgaaataaatcaatgtgttaagagaaagcgattttgttcttgctgtttggggaaagtgctctttactttcctattaacaaaaacttaatgaaccatttcacattcaaaaccccttaggtcataatgtctatt

SEQ ID NO: 94870 - DNA, 234 bp, Homo sapiens
gccgagattgtgccattgcactccagcctgagcaacaagagtgaaactccgtcccaaagaacaacaacaaaaaaaggtataataatacctaccacccttgttacaggaattacaagagttaacaccctttacatttaaagcagtgcttgacatatagtaagggctacacacgtgtgtctgctacatctattatttagtccccagaccccatgttcagctctactttgcctctct

SEQ ID NO: 94871 - DNA, 469 bp, Homo sapiens
ttgtcctgggatcttccttcacctttttcctgggatttccctttgcttctctgtattgaaccctagtttctggatcccatatctctactgccaactttcaggtcttcaattgtggtagctctccttactttgatcctggagcatcctgcgaactctttgcctcatgtagatttcagcctttgaggtcttctctttgttcttttttaaagtacaggttgagcattccaaacctgaaactccaaaatgcaaaatgctccaaaatctgaaactttttgagcaccaacatgatactcaaaggaaaaaaaaatgattggagtatttcagattttggatttttgaatttggaatgctcactggtcagtataaagcacatagtccaaaaactgaaaaagtttaaaatctgaaacacttctggtctcaagcattttggacaagggatactcaacttgcagtataaaccgtagtgata

SEQ ID NO: 94872 - DNA, 294 bp, Homo sapiens
tccacaatcttaagaattaccctctattgccccttgggccccctgtccccagaagcctggtcagccaagactcacatccccaggtggctggcaaccaccggaagtggctgtctcagggatactgccatttgttttcctgttcctgttcactcctgctggaactctaggtctgtttttctgccaatattcttttaactgttggaaagaagagcagtaatattcatgagaaccgtcagcccctacagccacaacctcctttacagtttttacaaaatacacttacacaccatctga

SEQ ID NO: 94873 - DNA, 278 bp, Homo sapiens
agaggggaaaggcaaactgtcagacagaaacaagagacaaagagaaacaatcagaaggaagcagacagacggaaaaaagaagaccaacagaaaaaggaaaagatgcacagagaaaaaggagaaaagacagaaagacggcaggctgggagaatacagacagcgtagttgacattcggcctggactgaaagagctcagatctggggaggtcaaggcggggagggctcaaagcgcaatccagattgaaagctggatgtacacagcttcggcgtaaggtcag

SEQ ID NO: 94874 - DNA, 390 bp, Homo sapiens
ggagactctcctgtatgttgtctgaacataactgggtacaatcttttaaatcataccccttaaaaatgttatgtttaaataacatattaactggaagacatgaatagcaggaaacatacataatataataaaaccttcacattaaaataaaaaacaacatgggagagcaaaataaagacattactaagtgaggtaaatgcaggagcagggcaaatcccactctacttctgaacaggagaggaaaggcaatgaaatatgtttcattaatccactatttgtgtgaccttgggcttattacttaacctcttagcgactccattccccatctgtaaagaagggataatagtatttactacagagggttgatatagagattaaatgggttagtac

SEQ ID NO: 94875 - DNA, 149 bp, Homo sapiens
atcatcccccatctagccctgtaagtgcgagtaccatcccccatcttaccctgcaagtaccatcacccacttcaccctgcaagtaccatcccccacctcagcctgcaagtaccatcccccacctcagcctgcaagtaccatcccctatc

SEQ ID NO: 94876 - DNA, 342 bp, Homo sapiens
gccaggcttgtgtccttcccttcaggacagcaagttccccccagccccaggcagctctacagatgccatctgagagccagagcccggacttgggaaccttagaaatctacctgatgctttactctattgcgactgagctggcaccaattggatttgttttttttggagggcatctttttttagagaaccaactcttggttttgatataaatatgcatatgtatgtgtgtacatatatatatatatgcatatatgtgtgatataaatatgcatatgtgtatttgtatatatatggtctacaatgcttgtagcattttgtatatttgtatacctctcccccgcc

SEQ ID NO: 94877 - DNA, 436 bp, Homo sapiens
gcacatatcaaaacattaacagcaggtgacagaatatttgccaacctgttagcaggttttaaaaccttctacaatgaacttttaatgggcacacaaataagaacacaagcataaaatactttttaaaattaaagtaaaatcttcccaactacgctaaaagctctagcctgaatattttatatacgagcaaaagtactaattaaaagcactagcatcttagaagaatttccttaaatccaagattttaaaattcccactctggctagctctaatgaagctcaaaacaaaatacaaaggttggtactaatagcccatcctcctaacggtagatttatttttcttgctagacttatagcaatgttaataaaagaaacctctcaagaaattttataatgccatctaagttttcaaatttgtaacttaaaggggaaagaac

SEQ ID NO: 94878 - DNA, 768 bp, Homo sapiens
aattcctttctgttttagtctccactgacactgcagtggaggtggccttattaccactgcgagataataaaagtcatgaaatttcaccaggcctcctctgatgccaccccagaagttaagtggaaagttgccccattatctattgagtcagagaagaaatccagactccccaaggggtctccactgataccacaggggtcagagacttcaggtttccatcagcggttcctcttccaggactcaggaaactaggctcccacagaattgcccatccttggtctctctgcatcttttggatggaagtggacagcacacataagacaaggtgtccaaatgggagaaaccaattgctgatggtatttagctaaatgactgtgtaagaatcacctgtggaaggtatattcccactcactgtgtggccaactcttcttagtaccaagtgcagtctctatcaagcaaatcaagcagaagggccagcttgggaggggacaggctaaaggaaacccatgaagcattgaatctgagctcaatttcaatgagaaccattcctgaacagtggaaagaccagagacatcagaaccatctttcccacttccattaagccaaggcatttggtcttatcaccaggacatgtagctttttggccatgttgaagaatctctgtggaaagaattcagctgctcctacctacagcagaatctggtgatttagaagagaagattgaacaaccaagatgaaaacccctgcttcctttacctgaggtgtggc

SEQ ID NO: 94879 - DNA, 1187 bp, Homo sapiens
  misc_feature (567)..(567): n is a, c, g, or t
aggcgtgagccaccactcccggctctgttataattttcgtttgcctgctcaagagcgatggggtgcagagtttccagagccatcttgcttttgtcgtactttttttttttttgagacagagccgtgggtgacggggcgagacccgtgcctcaaaaaaaaaaaaaaaaattgagggaggggcttgacccaggggtggcattgagccttgttaactcccagctttattggggaggatgaggcgggaggatggcttgtgaccccgagaagtttcgaaaaccagcttggggcaacattagttggagaaccttggttcttcaaaaaaaacggaagaaagggaaacacgaggaaaccagaggaaagagaagttaggaagtgtggcagaaagcgaagggggcggaaaaaaaaacccgaggaagaagttgtgaggggttaaaagagggagacaaacattgattgtagacctcaggagaattcccaccaggctgtgtgcggtcacgccgtggcaggtccgggggccattatctctatagttcccattcggagagggctcccaggtgtgttccccanaatttggcattattcaacggggcgtaattgggagcccaaagattgcctttagtccctctaattagccaatcttggccactctatacgcttccgcttttcagagtttccgcagcaccagttagggtggccgttccagaattatgtggggcggcctgcagtgggggggttccaccttatagggcaacacactgagggctcgtgggggcgaaagcatacgctgtgctcatccttaattattcctctcccatacccaggtggcggttttgccctataatgagaaaggtccatcacagagcgggtgtgacctcctgttggctcgatggactaatttccccagaggttggctttaaatttggacgcacatttttggtaggggcccagagggggtgtgccaacgggcggcccagtgggcctctttgtctggaaacaggccacagtggagaaccggctatagagaaaaacaaccgctgttcttttgcgatgttgtgtagggcccttgtgggactatattgtggccccccccagaaagttcctaactgttaacccgagagttccacatactcttcccgagagctttgcctcttgtcaaaatgaggcagagaacctgtttattatccaca

SEQ ID NO: 94880 - DNA, 748 bp, Homo sapiens
tgtttgcatcttcatgattaggagaccttgcattccaaggagacagatgtatttgcatctgttttctcaagagcccgcttcctggctgaaaattccttggaggaagggccaagacggcccctgtgttatacccagggaaggccaatgctgtctttcttgctaggtgctgaactgagtcctagttcaaatggctattatttgtttttaatttgagaatatttgaaaagctctcattgtaaaagagtcaagccatacaaaagtataatgagtatgattgtcataccacagatataattgtactagaaagatcatgttactttatttatttattttttttatcaaatctaacaccaaggtcctatcccattagctgcatagacatttgttttcaagggcacttctcctcatagagtagcacaaaagtcccagagttttatgaaaaccaagatatccaagggacccctctgatattcatccatgctggccaccacagatatgtttcttgtccaaacacaggcattcccttgaaatccacgcaggcacatcatctctcccaggggccagcctcctggggtctagtactcagtccttctccaggggacccaccgcttctgggggcacaggctgcagctttcccactacttcaggcatgggctccggggcccctcacactgggcttccaggacacctccttcctggccctcctggttctgagactttgacccctcccttcaccacaggcccttct

SEQ ID NO: 94881 - DNA, 546 bp, Homo sapiens
ttgtcctctgaccacctttacctgtgagcaccttctctcctcttctaggcagcccctcccgcaaggaggctgcagggccattcccagaagaacagtgaacagtgaaaatggcacctagcatttactgagcacttactatgtgccgggtgctttactcatgctgcaaatttaatcctgacacaatgctgactttgccagggagcagtattatctccatatcagcgatgaagagcctgagggtgagagagagagagagagagagagagagcctgcccagggacaaccaatgaggaagcagcatagcagcatagccgggactgaccctctgccagcctgacctcagagcctgccctccactccctgaatatccccagccaggtctttatgtgcctacgatactcacgctgtttccttgtctcttctccaggcctcccgcacgtgccaggtctcccctcttcccctgctgctgaactcagtccctgcagggctctgaagcagagaaaacctgctgttttctctgcccggaaagccgcccctactcatgtg

SEQ ID NO: 94882 - DNA, 465 bp, Homo sapiens
gttacagtgtacaccggggtaccaaaggctctgcgggaatgagacctgctttacatggttcaacccaacattcctcaagcgtatttcgctccatttggggaagcacacttttggagaagcactctcttaggtggtgcccagtgttagccagcacagctgtgccaccggtctgagctggcttggttagttgttccatctactcggattgaggtgggcaggagcatgtagctggcagaggacattcagaaatctactgtgttgagcctggggagtatgtaaattgtatcataggaatttaagctgatggctagattttactggtccaatatttgacttcaaaacagggaagtctcacattcacctaaactgcaacatatctagacgtagcatcccaccctccagtcttccttgaaaacagccacctcagttcaaaaattcagcatcatcgctaactcttttatcctc

SEQ ID NO: 94883 - DNA, 243 bp, Homo sapiens
gaaagctagaatgttacagatgatagaattgttagacattagaactattataactgtattccacatgttcaataagccagaagaaatataacatgcaaagtacacatagaacttataagtatgactcaaaccaaagttctagagatgaaatctataacatctgagatgaaaaacatgctggattggattaatagcagattagacatcatagaagaatggataggtaaacttgaagacatagca

SEQ ID NO: 94884 - DNA, 569 bp, Homo sapiens
tctttattatggatttaagaacataaataatgtcaacaacatccttgggaataattagtaggatgacatctgcatcccactgcccacatgcttaccttgagaacaactgacttggtgaatgagccaacaccccgtttcttaagtaagcgctccgttagggaaacctcactgtcaaatatattatatgctgtttttgactcctaaaaattatttttcattaaatagatcaataatttatatttcaatctctgtgtctgaataatactcagacactttcaatctgtcacaattaatattcttaaaaaatgtatcttgtaatcccagtgctttgagaggcagaggttggatgatcgcttgagtccaggcattcaagaccagtctgggaaacacagtgagaccccgtctctacaaaaagatttttaaaaatcagtcaggcgtagtggtgtatgcctgcagtctcagctttccaaaaggctgaggtgggaagactgagcctaggtgtttgaggttatagtgagctatgatcgcgccaatgtactccagcatgggcgatggagcaagatccggtc

SEQ ID NO: 94885 - DNA, 315 bp, Homo sapiens
aacctacaaactgcaaacacttggggctggagcattctttgcagtgggggctgtcttgtgccttgtaggatgttgggcagcatgcttggcttctacccatgagacgctaatagcaacctcttcccagggtgtgacaacaacaaaatatgtctccagacactgccaaatgtgccccaggggcaaaattgcccatagttaaaaaccactaatgggcctagaggggtgttccccagtttatgcaccacgctcaatatttaaaggagattttctctctacaccatttttctatagtatttcaaattttttttttttctt

SEQ ID NO: 94886 - DNA, 185 bp, Homo sapiens
ctcctccaaagaatctaactgcgtttgttcattctctggtgccttcaggtcttcttgaaatatttgtgttaagacttatctgcaggagggttgggtatggcaggcgtttacttgtcatactaaaagtgaaactatgcattaccttttttaatggttcctttatgttgcatattagtttactaaag

SEQ ID NO: 94887 - DNA, 265 bp, Homo sapiens
tgaacaaaactgaaagctcaacaaatagatatacatcgtaaaatagaaccaaacaacttctgaagctgaagactgcaatgaatgaaatgaaaaatgcatcagagagagtcaacagcagattcgatcaagcagaagaaaggatctgtgaactcaaatacaaagcatttgaaattatctagtcagagaaggaaaaagaaagcttatgggatttatgcgataccatcaggagaaataatatatgcaatatgagagtcttcaaaggaga

SEQ ID NO: 94888 - DNA, 409 bp, Homo sapiens
tggtttatttcatctgtgaccactgggtgagatctcattttataatggccttaataatttgccacttatgattacgataataacaatattttttaaaatcactggaaactttaattaggtatttccaaatcgctaggggttattaaccaagggtcaattttgctcccccaacccccacccagaaatatttggcaatgtctactgatatttttggttctcataattggaggtgagagtgctactggcatctagtgggtacagaacagggattctgctaaatatacttcaatgcactggaaaacttcctgcaacaaagaattatcccacccaaaatgtcaacaacgccaaggtgaaaaaaccatgccctaaagctacatatgatcactatcatttaaatgattattccagg

SEQ ID NO: 94889 - DNA, 322 bp, Homo sapiens
tcttctagcattgcttctttattaatgtcccattatgattataaaaggccaaaatgtttatttaaatgtagtcttcaaatatttttagggcactcttactcagatttgaatttatttatttttatttatttattcaatgatatttgatttatttaaatgtggcttttcacatttgatgatagcaactgtgttcagtagaaaaacatattataaactcacaatattttagctcctgttagcaaaaataggaacttgaaattctctagatctgtggttcctaaccctgactacacattcctgtaacctaaacaggctttaaaaa

SEQ ID NO: 94890 - DNA, 250 bp, Homo sapiens
cgagactccgtctcaaaacaaaacaaaacaaaacaaaacaaaaagaatgataatctactgagaaattcaagatagcctctgtgcctggtcatgtgaataaactgttattgatttatccacatttgatctcaaatcattataaatactttgggtaggatatgatacatctttgtattcaaatatttatatgttcttttagtgttttgatttccttcatatcacttaataagttaaaaacatagcattaatc

SEQ ID NO: 94891 - DNA, 248 bp, Homo sapiens
ctggaggctacagtgagctatgactgtaccactgcattccagtttgggagacagagcaagaccctgtcttttaaaaaaggaaagaaacaaacctcagaggtggtggacactcacactgcaagtgggccaaagcctgctggaaggggtaggatggttgtggagctcaggaatccaggctcctgagggcctggtgtggggagagtaaaggacaaagaggaggagaaaccctggccactgatcgcagcacc

SEQ ID NO: 94892 - DNA, 246 bp, Homo sapiens
tgcctgtatgtctgaggctgggtttgaagcctccagcgtgtttggagttaatccccattaggttggactccgcccctttctcccaaaggtaaagcaaggttttcaggcatcactgcaaagggcagctagtattcccatccttgtctaacaagctgtaaggagaagttgtttctgagatctgagcctgaagagagggaacaagtcagtcagccttcgtggtcagaaggtaaatatgcaacttgggcc

SEQ ID NO: 94893 - DNA, 3306 bp, Homo sapiens
cgaatcagccgggcccccagtcgctgccccatcaaggttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccaaccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtggctacaggccaggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 94894 - DNA, 3173 bp, Homo sapiens
cgaatcagccgggcccccagtcgctgccccatcaaggttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgccccacactggcctcttcctgcagcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccaaccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtggctacaggccaggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 94895 - DNA, 3803 bp, Homo sapiens
cgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccaaccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtggctacaggccaggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgaaaaaaaaaaaaaaaaaaaaaaaaaaaaaaaaggaaaaaaaaaaaaaaaaaaaatagggagggggcgatagtaaaaaatctcttcgagggggggaggagctgggtacggtgtagcgtgtgttttgtgttcaggtagggggtgggactagtagggagacgtgaatttattaagagaatggaggggggggggtttttaaaaatgagtatagggggggaaaaaggtgatgatcaggagagggtaattctgtgggcaggcacgagacccccatcaatctatgtggcggggggggggagagcacaacagtgttgtggcgacacaatctcttacagccaagccaactgtctactgacgctacgttctgtcggcgtgaaatatctattacaacttacaacaggtgttatattagatggtttggaataaccaaaaccgctgtagaatctatactac

SEQ ID NO: 94896 - DNA, 3327 bp, Homo sapiens
cgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccaaccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtggctacaggccaggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtacctgcctctttggtttggacctggccagtcgggtcactgcctccacgtctgaggccccgccagctggccgtctgtcctcgccagcctcaggctgctgcgctctctcggcttttacggacctctgaggccgaaaccccacctcgaagtttccccgtgacagtgcgtccgagtccacat

SEQ ID NO: 94897 - DNA, 1125 bp, Homo sapiens
ttggtgtggcgttctagaggatccctgctattatcggcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 94898 - DNA, 818 bp, Homo sapiens
aagatgaattcttgctctgttgcccaggctggagtgcagtggtgtgaccttagcccacggcaacctccatctcctgggttcaagagattcttgtgcctcagcctcccaagtagctgggattgcaggcgccctccaccatgcttggctaatttttgtatttttagcagagacaggtttcaccatgttggccaggctggtctcgaacccctgacctcaagtgatccacctgctttgccattctcctggtgccgctgctgctccctgtttctggagctggatgttccccagctggcagttgagctgcctgagccaatgtgtctgtctttggtaactgagtgaaccataataaaggggaacatttggccctgtgaaaaaaaaaaaaaaaaaaaaaaaaaaaaaaaaggaaaaaaaaaaaaaaaaaaaatagggagggggcgatagtaaaaaatctcttcgagggggggaggagctgggtacggtgtagcgtgtgttttgtgttcaggtagggggtgggactagtagggagacgtgaatttattaagagaatggaggggggggggtttttaaaaatgagtatagggggggaaaaaggtgatgatcaggagagggtaattctgtgggcaggcacgagacccccatcaatctatgtggcggggggggggagagcacaacagtgttgtggcgacacaatctcttacagccaagccaactgtctactgacgctacgttctgtcggcgtgaaatatctattacaacttacaacaggtgttatattagatggtttggaataaccaaaaccgctgtagaatctatactac

SEQ ID NO: 94899 - DNA, 3355 bp, Homo sapiens
cgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccaaccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtggctacaggccaggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 94900 - DNA, 3147 bp, Homo sapiens
tgggaaatccctccctgtgtaatgttgcaacacacaggtctaccacgtggaaacttgcaaagatgtatgggtagaactaaccccttctgacctctcaattaaggcctttaaatgtcttctgtccattatgcacttaaacttggaagggcttgggggccttgaaggcagggaagccctggccctctgcccaggtgacgggagccacctcctctgccgcaggactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccaaccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtggctacaggccaggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 94901 - DNA, 3260 bp, Homo sapiens
cgaatcagccgggcccccagtcgctgccccatcaaggttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagccagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccaaccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtggctacaggccaggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 94902 - DNA, 2898 bp, Homo sapiens
cgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccaaccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtggctacaggccaggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagggtgaaggctcccgggggatcctcagagtcgccagacaccag

SEQ ID NO: 94903 - DNA, 412 bp, Homo sapiens
gacaggtttaccagtagttaagtcattcagctaccagaagtgttactagtttctcatttaacaaacgtgcacttcctgttatgcacagggctgtatgatgctgctatggaatgaaagtgaacattcagaggtggcaaagcacggtggtaaaagcaaaggctgtggggccgacactcaggttcaaattcctgctcccccttgcgctagctgcctgcctttgagcaaactactaactcactcggatgctcagttttctcacctgcaagatgggggtaattctggtaaactactcatggtgttgtttgagcaactgaatgagtcacaatgtacaaagcaccaagcagggtgctcagcacgtagccaggtcctcacaggaggtaaactcttacgactgttagcaaagatttatcca

SEQ ID NO: 94904 - DNA, 829 bp, Homo sapiens
ataggttttcataaaggttgacataatttgaatcaaataatttaaattttaaaaacctccaaaaaaccaatttccaagtacaagagagttgtagtcctcactagagaattctaccaaacatttacacaagaattaatgatgattttacacaatgtcctcagaaaatagaagcgggaatatttattttatttatttaattagatggagtcttgctcagtcacccaggctggagtgcagtggtgtagtctcggctcaccgcaacctctgcctcccgggttcagatgattctcctgcgtcagcctcccaagtagctgggactgcaggcacatgccaccacactcggctaatttctgtatttttagtagagacggggtttcaccatgttggccaggctgttctccaactcctgacctcatgatctgtccacgttggtctcccaaagtgctgggattacaggtgtgagccaccgcacccggccaagagggaacatttcttaacacatttaaaaaattattttgatgccaaaatcatacagacagtacaaaaataatacaactacagacatatacctctcataaatttagtagcaaaaatctttaacaaaatactagcaaatagaaaacagtcatgtaaaaagtatacaccataataaccaagtgggatttatttgagttatacaagcaaggctggttcaacattcagaaatcgatcaatgtaattaacccagcataggctaaagaagaaaaattccataacatcagttaataatagagcaaaggatttgacaaaatgcaatatccatccatgataaaaactctccatactagac

SEQ ID NO: 94905 - DNA, 1022 bp, Homo sapiens
tttttagagtagaattttgcaggtaattttaaatctcaagccctatgaaggttactaaaaaaaaaaaaattcccaaaatagaaacattaaaaaggagaaataagatatttacttcaaaaaattactcctttggggtcttgcagtatgatatatatgagttactgctcagaatatatagactgtcctcctatcctgtgcactgggatgctcactaccacttcttcaaatccagctaaaagcatcacggcctcaatgaagcctacttcagccaggactgttcacgtgcctcctctctgctcgtgtcctacatattacctaagcagagctcaccaacaatatttttcatcaacagcttagagcagcgctgccaaataaaaataccatgtcggtcatgtaagtaatttaaaattttcttagtagccacttttaaaataggaaaaaggtgaaatcagtcaattttatttaacccgatacatccaaaatattatcactgcagtatacaatcaatataaaaaattacggagattttcttttccatgctcagtcttagaaatctgtggcatattttatatttgcagaacatcacaattcagactacccacatttcaaagattaatagccacatgtggctacaggctgctgtactatttaataaaaagtgcatatctagagtctagccccttgctttataaagtgtgatctaccatccagcggcatcagcatcacctgggatcttgttagaaatgtagaaaggcagcccatctcagaactactagaagaaataaatttaacaggatacccaggattggaatgcgtagcaaagactgagaagcagtaaattagatcacatatagcatgggagttttacagaattgctattgccattcaactatgatatggtattatcccactgactaatatagaacactatttaaataacaatagtttttctatgaatcatgttttctctacactgtccaatgcaattttctacaatgatgaaaatcttcatatatgtgctg

SEQ ID NO: 94906 - DNA, 2582 bp, Homo sapiens
gagaaacaagttggatgacctaacatcctgttagagactggctggaagaggaacccagaagtagactgcactgtttgaccctcaccggtcggtcgtatgcagagtggttgtgttcttgagctgaggaatgccggccttgttgcctgtttggctttgattacagtatttgtagcagaatgttgctatggagattcatgccaggtacgcagtgggaggtgatctagaagaccgtgtgccagccactcgtaggtaatcactggcgctcagaacatgctgagacaagagttctcgttggtttatttccttccccagctgtgtgagttttcagatttcatcattggaaatgatgtcttacccaatgatacaaaagcagaggaaatgcctttgtagaatttcttccaagggaagaatgaaagtagagaggtgacttagcttagctttgttgtctctagaatacgttacagtgtgtcaagggaaggcttttcaaagtatttgtcaagggattgtgaggaacgtagtccattactttgtcaaagagtttatgtgaaaagtagatatttgaataatttcttatatttcaagcagcgttacagctaatgtttcttttaaatcaaaccttttatctccaaggttaactaatggcacctcgaggttacatctgcagcccagtgtctaggatagtagaggaacatagtgcaaattcatgtttgtcatcagagctgggtgtggtggctgacacctgtaaatccagctactccgaaggctgaggtgggaggatctcttgagccccatgagtttgagaccagcctgggcgacatagtgagaccctgtctaaaagaaaaaaaacaaaagtggtctaacatgtttgccatcagacagtagttttcattaatgtgaacatgactgaggtcaagaagtttattcatgtacccagcctttgcggagcatctgtggtgtgccacttgggggatgtgaaaccagtaaaccacatagttttcatcatttaggatcatgcaggtgtacagggtacatgtgaaacagtagtgaggcccacacactggtggggggagatccagtaagcctttggaaggtggggggtcagcagggagtgtttcctggagaagatgaatgactcataagttatgattcagagaatgagttaagagttagccaggtaatgagggagaagggctcccaggcatatgggaggaacaaaggcacttagggaagaagccgggacagagtgtgtgtgcatacaggaatattataagtattgctggagggaccagggcagggtgtagtgggggctgaggcccaaaaggcagtcagggaccagatggcctcatatgccctgttaaggagcttgggcttgatcctctaggcagggagccgttggaggatttaagccagggagtgctgcggttggtcacactcgccatttatgtagatcgttttggcagccaggggaaggatggatttgagggggatgagattagaaagctgggatatgagttaggaggctgaaagatggttgataaaaatgatcgttgggcagccgagataactgacttcaaggacatatactggacttatagcagagcctgttgagtcttgcttttgcacacagttcaaataatcacttagtcatgtggtttatctgccagtggcaaatgttaagactgtggggaaaaactagaagaaccaataacatcatcaagaaataagtgataggaggcaaaagtcataaaagccgtacaaaaattggaaagttgactgttgaagcatcgtggttaagacaggatttgggttgctaggaaactttggggcaagtatttaaccttcctaagtgtcagtttcctcctctttaaaatgggagttagtaataccatccttattgagttattctgaggattaaataagatgatgcgtataaactattttacaccatgcctggcaagaaaacccagtaagtggaagctgttactgtgaatacattttgtggccttttgattagggtagtgttttccttagatctctaattttgtggatgttaattgtattataattacattaaaaagagttccatggtaaatcaatttgggaattaaagaggggtttgtttttttgagacagggtctctgtcgcccaggctagagcatggtggtgtgaccatagttcactgcagcctccatcaaacgagcctcctgagtagctgggattacgggcgcttgccactacgcctggctgacttttttgatttctagtgtagatgaggtcttgctatggtttcctaggctgttctcaaactcctgagctcaagcaatccttctgccttggcctctcgagtgttgggattgtaggcgtgagccaccacaccggccaagagaggttttgtttcttctgctagagtgtggtgaagctccagaggggcagcctacacagtatttctcgttcacacttgattgcaactcttagaaaagctcacaggactgagtccttgggggcacactttggcaaatgcttatttaggggagaaacatacccatctgcttccatagcccaagagtattgctctatcagag

SEQ ID NO: 94907 - DNA, 4472 bp, Homo sapiens
cctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgcccgggaacccgtggtcacacacacgcactgccctgtcagtagtggacattgtaatccagtcggcttgttcttgcagcattcccgctccctttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatctaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgttcccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggagaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacataagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgaaaaaaaaaaa

SEQ ID NO: 94908 - DNA, 344 bp, Homo sapiens
actttgagcaacaaccaaacaaaaaaagtctgaaaattgaaaagggactcagatttgagagaattgtccccactccccaccatatctttcctagtggcccttgtggcatttgggaagctggccccagggccaagtgctggtcttagctcagtcagcttcctgtccctcacgtgggctggccttgccaggtgccctcccctgccacccccctcagacacagtggagctggcctcaggctgtccaaccacagatccatgggacttccctagccctccacccctcttgccatttccgcacaccacactccctgcagaccctgctgtgtgtgggtcacccagggaagg

SEQ ID NO: 94909 - DNA, 758 bp, Homo sapiens
cgccaggagggggcttcccaggtgagcccgagacgggatcgaaactcctctccagtccacgaaaacgcccaagaataagttgttgagtaaaacccacccgtcctccttgtaaaccccccaatttcctttccaaaaccccatccctctcccaaataaatcacgagcggctctcttcccatgccaagcgcccttggcttcacaataagcccggaagattttaagcaacgatattgaggtttgggaagagggagcgtggggcgtgggattcgctgctgccctgggttcagtgttcttggttcttttcacgccaggcgtgataaagcaaaatattttaactgcaacctacaagcttgttttttatctttttttcccctaacttttttttttccttccaagaaacagatcaagaaaaactaattacaaggcacggcaccaaagttaaatgaaaatgtaatccggcaatagagagagaaaattaattttttaaaagatagatttgagttagaaacaaaaatacattgttctccctggtaacgtttgctaaacctatgctcgatttcgggctgaaaaatcagtagttacccagaactctgaggtcactctctggatgcgttttctttagaaattctaattcgaaaatgttcaagccttcatttggagctttgttttgttttctgtataaaaaggtttggggtgttttgcttttgtttgttttgttttctttttattcaaaaatactccttctctgtttagatata

SEQ ID NO: 94910 - DNA, 1561 bp, Homo sapiens
aatgacttaccatctctatccgcaatctttgacgtggaggagtccaccagtgctccctggactggctgttgttgtacacagcagccccacccctgccaggaggccttccgcctctgtggctttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttggctgtgtctctttatttatgctgtgccattcaaagcacatgttcaagagaacagaacactctccccgccccagcctgattcctgccttacccaggaggagggtgcctggccccagtacccagggtggcacgactgggctaagtggacactgagcttcatcaggccctccctgggtaggagcagctttgtgtcactaaagaaagtgagggccactgtctccggcgggtgaggctgcagcccagtttcacatgcgaggaggcctaatcaggagtttcaattccagatcgggctgggtccagccccaaaacatggcctgctggctggggagtgggaacactcagagaaaggggagatctgggcctgggaagattccggggcaggggtgagcggacgttcacatgagtgggtctatagcccgctccgggcatcatctagacttagcatgcattcactcccccatcacatattccaatacacaccctgccctaggcactgagagctggagagttggtgataagcgagacgaacacatttcctgccctcatacacacataaataaagtgaatgagatcatgtc

SEQ ID NO: 94911 - DNA, 2018 bp, Homo sapiens
aggcggctgtatctggagcagtcggggcgggcaggcccagctgagaggtgcgcgggcgaggacagcggcagcgatgcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttggctgtgtctctttatttatgctgtgccattcaaagcacatgttcaagagaacagaacactctccccgccccagcctgattcctgccttacccaggaggagggtgcctggccccagtacccagggtggcacgactgggctaagtggacactgagcttcatcaggccctccctgggtaggagcagctttgtgtcactaaagaaagtgagggccactgtctccggcgggtgaggctgcagcccagtttcacatgcgaggaggcctaatcaggagtttcaattccagatcgggctgggtccagccccaaaacatggcctgctggctggggagtgggaacactcagagaaaggggagatctgggcctgggaagattccggggcaggggtgagcggacgttcacatgagtgggtctatagcccgctccgggcatcatctagacttagcatgcattcactcccccatcacatattccaatacacaccctgccctaggcactgagagctggagagttggtgataagcgagacgaacacatttcctgccctcatacacacataaataaagtgaatgagatcatgtc

SEQ ID NO: 94912 - DNA, 525 bp, Homo sapiens
gtagagatgggtttttgctctgttgccctgcctgcttccactttctcttcagcttctcccttgccacctgctggcttccccagtcccatcccgcctgttgcatcccatagccccactcccacgcccctgaccatgacttgaagccatgccaagtgaccaagatgtcccatcctgagttatcctctggctgacttgtatcttcttctgtggctcctcctctttctgtgtccctcaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaatt

SEQ ID NO: 94913 - DNA, 335 bp, Homo sapiens
taatgccaggctctgtagtagctggaatctgtgtaattttacttatcatatacaataatgccaagatgatatgcttatcaccactgtacagttgaggagagccagccacagacaggttaagcaacttgcccagggtcacacagcagtcaggactaaaacccaggtctggctggctgattgatccttttcgttcctaaccactcctctatagagcaccacacatttgcatatttagatatatttttgtcatgaatttggcgcaaacccaaagcctctccaggcctcagaccctgttctgtgaaatgagtgcaatcatgtctgctgtaccaactgta

SEQ ID NO: 94914 - DNA, 602 bp, Homo sapiens
tgcaatagtgagaacatgcttaacgtgtctcgtgacaatcttacattttagatggttttaatgcttactttaagatttggccacttatctgactttcatttttaagataagaaatttgaatagtaattacactttggaataaaaattttctcctaatttcctttcaggtttctgcactgatttgattgaaatatatccagagattgcaagccaaactgccaataagcatctgtcatttgcaattatttatctgtgtgaatcagaattttctgaatactctgcaaacaaaatacagaaataaactgcatgagttgatgttaggctacaattaacttttgaaaaattttggtatacataaaagtctcattttcctaattgattgctcttatatagtggagtttctttctcctaaacaaaaattttaaagcaactgttctaaattagttaggtgggaatatagacactcagcacaaactctaaccaagggcaaacaattcaagtgcaggcccctatgagagtgagtgaagagagattttgtaaacaaagaagatacagaaggcttttccacatttggtggccccttcgtaattcacagcaatata

SEQ ID NO: 94915 - DNA, 310 bp, Homo sapiens
caccactgcactccagcctgggcaacagagcgagactcctcaaaaaataataataataataggtgaattgatgaggaatgggcagatggatagaaatatatggaacaaagccactatagtaaaaacaaattgtaaaatctagctggtgtctctatttaaaaaaggatcttttggccaggcacagtggctcacacctgtaatcccagcactttgggaggccaaagtggatgaatcacttaatttcaggagtttgagaccagcctggccaacatagtgaaaccccatctctactaaaaatgcacaaaaaatt

SEQ ID NO: 94916 - DNA, 349 bp, Homo sapiens
ccatgataaaaagaagtggtaatagctggcatctttgtctggaaggcctgctgtgaccttaactgtaggttcctttctccagtgactcatcttgagattacccttctctcatacctccaacatttttgagacttggatattccaagcctgtgctaaccattcacttctttggctacactcagcagaagagaaatagaaagctgccaacctcttagactcaaacgaaatcattttcccatttgttaccctcagaaattggctctttccatccacaggttccacatccatggattcaaccaactgtgtattgtcagtattcaaaaaaataataaagtaaaaataaacaaac

SEQ ID NO: 94917 - DNA, 146 bp, Homo sapiens
tgatgttgtttcttgagaagaaagaaggaggaaccagacatgtgtcattcccagagagaaaatgaatcacaactcctgtagttacttggaaatctctgaggtgctaccctcaccccatctcctcacccattccaagagaaagggtt

SEQ ID NO: 94918 - DNA, 332 bp, Homo sapiens
agacatctatactctatagtcaggtctaacatatgaaataattaacttgtgtgttgaagtacaaaatactataatttgtcatttaagggaatgtaagatttagatgatccttaatgctccttgcaacttaaagattctgcgcctcactgacgttaagcttgtatgagacctgtagtctgttggaatacataagcagctgcctgtgttacacagttgtgaggtggtaatatacttgtgatgattttaaagagctctttctattgtcactgacaacagagtctaagaaaaacctgaattattgcataatcaaataagacctaatttccctttct

SEQ ID NO: 94919 - DNA, 401 bp, Homo sapiens
tggggtgggaggagaatgatgaaaaccacaaatacaatgatgacaacctctccagaagagctgagcagtggagaaacacgcaggctggttgaaagccaacacacttcccatggggttgggcagagtacccgagtctacacatttcaccatcatgcccaaaggcctcaaaaatgcagccccactcctgccagctcctaactccccctgcccaaaccaccagccaaccaagcaaccaacagcacccaggcgaaagctccatgacccgccctgccacccccttcataaagtgcagcccccggcttgcctgtgcttctgtgcccaggaacagagcagcccgtaatggctcacactggccgagcacttcctgtgtgctgggttctggccaaaggctgtactgaatc

SEQ ID NO: 94920 - DNA, 274 bp, Homo sapiens
ttcccactgcaatccaaatgccatgttaattatttttgtggtcaacatttctgacctgtccacaaaacagattatgaggggttaaggaaagactaatgtcttccagaaatatagggttaaaggtatagtctacctaaagcagtccctggctatattgtaggtagcattgagatacaatttgaatcaagaaagggacacctttgtctttcaggcaactaagtgatgacgatccatatctaccatatctgatttaattatacttgtattaattaaa

SEQ ID NO: 94921 - DNA, 669 bp, Homo sapiens
acctaggtacttgatccaggtatatgtcacattcccaactgttggctgggcccaagcaaattagtaaaataaattaggtgctgtgtgaaagtatacgccacaatcacacctgcgggaaggaccaggaataaatttcacaattctacgtatttcccagctttaggtctgagagtctacacttctgagctccagttcttctcttcactgctctgcgtcctctgttcctagaggccaagccactgtggccttgtgttctgcaggtatccgcagatttatggctaaaagaccgggatcccctggaagccgagaaatgggactgttgacattcagagatgtagtcatagaattctctctggaggagtggcaatgcctggatcacgctcagcagaatttatatagagatgtgatgttagagaactacagaaacctggtctccctgggtattgctgtctctaagccagacttgatcacctgtctggagcaaaataaagagccttggaatataaagagaaatgagatggtaaccaaacacccagttatgtgttctcatttcacccaagaccttccgccagagctaggcataaaagattcactccaaaaagtaataccaagaagatatggaaaaagtggacatgacaatttacaagtaaaaacatgtaaaagcatggg

SEQ ID NO: 94922 - DNA, 2365 bp, Homo sapiens
  misc_feature (4)..(4): n is a, c, g, or t
tttnttaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagcca

SEQ ID NO: 94923 - DNA, 562 bp, Homo sapiens
agtcacaggagacatttgtgcacacaatcgaacatatcttaatgatattgatgaatgattttgacacctattatgttcctttctcattgggcttggccattctgtggctgactatatgggcactgcatttcctaatcttagagagctctaacgccaagacatctgccttgtacatctcaggtggcctcctgtaacctgtgctgtctgtttcttgcagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagcca

SEQ ID NO: 94924 - DNA, 3473 bp, Homo sapiens
  misc_feature (4)..(4): n is a, c, g, or t
tttnttaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcattattttactttgtaattttaacattatgtgtaggaccatagtaaaacattcatttcacacagacatctaatctcacctcgtgaaaagtgaaaataaaggaaaactattagattcatccaaaaatgcaacacctactgggagtgagatgtgataggaacagaaaaaaaaaaaaaaaaaatcacccggatctcaatagttttttctccctacttaaagttgttaagttggatatctacattgtgtttttacttaggcaagtccaatcctaatttttttaaaagccccttttgggggcagtctttttctgactttagctggctatttttgtaacaattacattaaaaattcggtgactgatc

SEQ ID NO: 94925 - DNA, 1569 bp, Homo sapiens
  misc_feature (61)..(61): n is a, c, g, or t
actaccttatgcaatgaacttcattttattctcggagataccgcagagagcaaaagtccantatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcattattttactttgtaattttaacattatgtgtaggaccatagtaaaacattcatttcacacagacatctaatctcacctcgtgaaaagtgaaaataaaggaaaactattagattcatccaaaaatgcaacacctactgggagtgagatgtgataggaacagaaaaaaaaaaaaaaaaaatcacccggatctcaatagttttttctccctacttaaagttgttaagttggatatctacattgtgtttttacttaggcaagtccaatcctaatttttttaaaagccccttttgggggcagtctttttctgactttagctggctatttttgtaacaattacattaaaaattcggtgactgatc

SEQ ID NO: 94926 - DNA, 1724 bp, Homo sapiens
agtcacaggagacatttgtgcacacaatcgaacatatcttaatgatattgatgaatgattttgacacctattatgttcctttctcattgggcttggccattctgtggctgactatatgggcactgcatttcctaatcttagagagctctaacgccaagacatctgccttgtacatctcaggtggcctcctgtaacctgtgctgtctgtttcttgcagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcattattttactttgtaattttaacattatgtgtaggaccatagtaaaacattcatttcacacagacatctaatctcacctcgtgaaaagtgaaaataaaggaaaactattagattcatccaaaaatgcaacacctactgggagtgagatgtgataggaacagaaaaaaaaaaaaaaaaaatcacccggatctcaatagttttttctccctacttaaagttgttaagttggatatctacattgtgtttttacttaggcaagtccaatcctaatttttttaaaagccccttttgggggcagtctttttctgactttagctggctatttttgtaacaattacattaaaaattcggtgactgatc

SEQ ID NO: 94927 - DNA, 2725 bp, Homo sapiens
  misc_feature (4)..(4): n is a, c, g, or t
tttnttaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaaaaaaaaaaaaaaaaaaaaaaaaaaaaaaaaaaaggggggggggggttaaaaaatatcccccggggggggccccatttttcggtccccctttttttttgtaaaaaggggggggccccataagggagagggggatattaaaaaagaagggggacgggggggggggtgtttataaaaacgggtctgggtggggggaaaacggggtctggggggcttttgttgggaagagggacccttctttcggggggtggggccaattttgtggacattccttaggaaattttaagtcgggggaatttaactttggggttttggggtgtacccggattgtttgggggaaattggttccggatttttagata

SEQ ID NO: 94928 - DNA, 956 bp, Homo sapiens
tgactccgactcaccttttaactactcgtggccttcctttcccaaaatgaagattcgaagaaggacgtccaaacaagatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacacacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcattattttactttgtaattttaacattatgtgtaggaccatagtaaaacattcatttcacacagacatctaatctcacctcgtgaaaagtgaaaataaaggaaaactattagattcatccaaaaatgcaacacctactgggagtgagatgtgataggaacagaaaaaaaaaaaaaaaaaatcacccggatctcaatagttttttctccctacttaaagttgttaagttggatatctacattgtgtttttacttaggcaagtccaatcctaatttttttaaaagccccttttgggggcagtctttttctgactttagctggctatttttgtaacaattacattaaaaattcggtgactgatc

SEQ ID NO: 94929 - DNA, 524 bp, Homo sapiens
agtatagatggggtttcaccacattggccaggctggtcttgaactgctgacctcaagtgattcacctgcctcggcctcccaaagtgctgggattacaggagggagccgttgggcccggcctaaaccaccaattcttaaggatgagcatgcctataattcctctttttccatcctctcttttccataccgtctccattggagattgtatcaacttctacagctcttttgaaaagattggaagtggagaaaggtttacctagtactcttgcttcctttagctcatgttttacggagccttactttagctaggatgctgtttcatctgctcaccttcctattttatgtaggatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaa

SEQ ID NO: 94930 - DNA, 2152 bp, Homo sapiens
  misc_feature (4)..(4): n is a, c, g, or t
tttnttaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggtaattaacactttaaacatcatctgtatagtttgaacaagaagttgtccctctgaatggttggctcttgtgtagagtgaatcaaagtcctccctagcatgggaataaatcggtactgatgagctggagttt

SEQ ID NO: 94931 - DNA, 2443 bp, Homo sapiens
  misc_feature (4)..(4): n is a, c, g, or t
tttnttaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagcca

SEQ ID NO: 94932 - DNA, 959 bp, Homo sapiens
tgactccgactcaccttttaactactcgtggccttcctttcccaaaatgaagattcgaagaaggacgtccaaacaagatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcgtcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaata

SEQ ID NO: 94933 - DNA, 425 bp, Homo sapiens
  misc_feature (7)..(8): n is a, c, g, or t
  misc_feature (116)..(116): n is a, c, g, or t
cctacgnntgttcttttaatagctttatctaatataacaataatcggaataattgttaaactggcttcccaaaactttagttgggggtactcttgcatttctgaagctctggcgtntggggaggtagtcactgacatttctttgagaaccctgtacatgtggccatgaaccctctgccaaagataaggaaactttatttaaagcttgaagattttgaaatgtggggcttaggctttaatggaaggcgaaaataatgcagtccgtgcttttaaacagaataaacaagtaggataacattaatcaataagtcttagttgaggttgcctcacagggaaatctatggcaccttacacattctccgtctgtgtaagggcatttgcttgttgttatttagatgtgactgacataatttggcaatctggttt

SEQ ID NO: 94934 - DNA, 222 bp, Homo sapiens
tttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattag

SEQ ID NO: 94935 - DNA, 668 bp, Homo sapiens
cacattagcacatgaagatgcgcttcattctgtttaatggccgtgtgtcattctattatgtagatgtgccgtaagtatttatccctcttcagttggtgggcagcatgtatgttatttccagtttttagtcattacaaaagatattgcagtgaacatccttgtacatatatcgttgtatagttgcgcaggtatatatgaaaaattcccagcagccaagctaaaaaatcgaagaatatgcacatttaaaattgagttagatattgctaaggttttcctgcaaagatattgtaatcatatatactcccaccaacagtgtatgacagtgctttcttccccacatcattgccagcactggtacgatcatactttaaaaactttgttggccgggcgcggtggctcacgcctgtaatcccagcacattgggaagccgaggcgggcggatcacctgaggtcaggagttcgagaccagcctggccaacatggtgaaaccccgtctctactaaaaaaacaaaaattagccgggcgtggtggcaggtgcctgtaatcctagctacttgggaggctgaggcaggagaatcacacgaacccaggaggcggaggttgcagtgagctgggatcgcaccattgcactctagcctgggtgacaagagcaacacttcatctcaaaa

SEQ ID NO: 94936 - DNA, 2677 bp, Homo sapiens
gcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaa

SEQ ID NO: 94937 - DNA, 1948 bp, Homo sapiens
gtgcaggcaaacagcaaccattctgccttgacaacacactgaacatgtggctgctttaatccagagagaaaatgtcttcctggctatcggctggctctccgagctctttatctgttgttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaa

SEQ ID NO: 94938 - DNA, 2759 bp, Homo sapiens
gcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggtgctgtggctcacacctgtaatcccaacactttgggaggctgacgggggtggattgcatgagccttggagttggagaccagcctgggcaacatggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaaaaaaaacaccaacaaaactttgtggggggcctgggccccgaagaaagttttcaaacccttcgtgggggggcgggcccctgtggttagggcacctgtgccctagcgggtcccaaagaacaccctggccagacaaagtggtcgggttccccccaaaaaaaccccggggcccgcgcgttgacaaaccccagggtccggggcctccggctca

SEQ ID NO: 94939 - DNA, 2772 bp, Homo sapiens
gcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggtgctgtggctcacacctgtaatcccaacactttgggaggctgacgggggtggattgcatgagccttggagttggagaccagcctgggcaacatggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaa

SEQ ID NO: 94940 - DNA, 1367 bp, Homo sapiens
gcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaactcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaa

SEQ ID NO: 94941 - DNA, 177 bp, Homo sapiens
acagaaaacccctggcgaggaagaggtgtgatttgatcagggtggctgcatcagacaggcgttcagtacctttcccaccagagctggtgctgctcaggagctgagccaagtcagggcctcatgcagcccagctctcctgcctgtgagggagacccaggcgtcagtgagatgtccctt

SEQ ID NO: 94942 - DNA, 1260 bp, Homo sapiens
caggctaacattacaagggaaatgaaaataaaagaaacaggaaaatgaaataatacacatgattaataaggtgatatgaagatgatgtagcttaacattaatagatgaaaaagcagtttctttgtaatattacattatcaatgatcacaaatacagaaatctaacatttgtatagaattttaggaaatagggaactcttaaacactgggaaaatttactccagttttgggaaatttactcaaaatttagatcttgtatgtactttgccctggcagttccaatctgtaggaattattccaacggagtagttggacaaattgaattttatgtataagtatgtttcttacatagaaaatctatagctaatttatcacccccaactacttatgtatcaattgatttaaaaaaatagattggggggtgttcattaaatattaatttaggtctatttaggtcaggttctgggctagattctggagacacaaaagtgaataagacatagtccctgtccccttaaagctcataattcaaggataggcagatgagtaagcagacagcaacacactttgaaaggcgctattgttaaggtgtgttccaaatctgaggaacccaaagatacctcattctactgacctctcttcttaactagcagcttgagaaacaggtttgggatgccaatcaaagcatttgtaccacctaaccagactcccctgaagctactgagacagtctaatgtagtgtagtctagtgagacatatacatgcctcattttgtcttttgtgtatatcaaattttacataataaaacactttaaaataagatgtttttctgtctatggaaccagaaaaaacaagaaaaaaaggttggtgaccttgtgtgctccccaaacaaggatttgtggagagtgggcattctatactattgttggaaatgaaattagtacacactctatggagggcattctggtaatatctattgaaaactttaaagtgtatatatcatttgatccagtaattacacttttagaaatttattttaaggaaatagcagtataagtgtgcaaagacatacttctaaagatttttatttttataataattataagcctaaaatgttgggaaaaaaatcaattattcaacaagtgaaatttggttaaataagcttcagtattgacctgaaaaaatgtccacattgttaagcaaaaaaggaggaaacaataagaaagagaaaagtgtttcctgacagacaggagctggcctg

SEQ ID NO: 94943 - DNA, 422 bp, Homo sapiens
ggcatgggccactgtgcctggcccacattttattctttaaaaatgcctaaatgtggctgggtgtgttggctcatggtctctaccagtgagacccctggtctctaccaaaaataaaagaaattagccaggtgtgatggtgcatgactgtgggtcccagctacttgggagggtgaagtgggaggatcacttgagcccaggaggttgaggctgcagcaagccataatcacaccattgcactccagcctgggtgagtgagagcctgtcccccccaaaaaagtataaacgttcagaaagctactaatatcattctgtgttatattttcttaggctttttcaaccttcgtatatctgtactgttgaaaatacaatttcaaatagcaatttcaaatgacaatatgatgagggtgagtgcttaatggaga

SEQ ID NO: 94944 - DNA, 716 bp, Homo sapiens
tcatgtcatgattagaggaaccatttctatagttctataaggaaagcaatttcacaattttcgtatttgcagttaaatgtcatttaatagttaaaaacatttttgaaaatctgaataaacttaaggccctgatgctatggttaaggttcttgcctttttatactatatacagtagaaatgggaaagtgtaaattaaggtcatcttcatattatctcttttcataacttgaagaaaatgaagccacctctcagtcttccaaatgttaattaactgtgttactttgaccttttgtaagtgatcccattcagctagtaccaagctgaagattgatattcgttaatggttaatataaatttactgctctaggttaagcctaacatatgtaattgctactcagcctattactttttagtccattgggaatcactaaaaaaagtagaggctttagcttcattcctcggctgcttaaatcatattgtaatgttttaaattgttatgtcgtcctgtataaccttaggccccagtaactgattaatatgagtcagctttaagttaattacagatataaaaggtaatagacacataggcatccaatcttgggtcagtttaattttttaggggttgaatttacagaagtgagtaggaaattaaattgctttatttcttctaaaaccctgacacaaaatcataaggttagaacacattcagttgaaat

SEQ ID NO: 94945 - DNA, 351 bp, Homo sapiens
aggatgggaagtggcagcagctatgggagattgagtgggagttggtccaatgagtatatatattaaggaaaataaaagccagattaatgtaaagatgaaattaatgaggtgggcattctaggcttttggacttagagccttcaataaaaaacctgagctgggcagggtggctgatgcctgtaatcccaacactttgggaggccaagatgggaggattgtttcaggccgggagtttgacatcagcctgaacaccatagagagatctcatctgtacaaaaaataaaaacaaaaaatttagccaggcatggtggcttgtgtctatagtcccagctactcaggaggctcaggtgt

SEQ ID NO: 94946 - DNA, 422 bp, Homo sapiens
tatactttaagttttagggtacgtgtgcacaatgcgcaggttagttacatatgtatacatgtgccgtgctggtgcgctgcacccattaactcagaaatttaaaaaaatctgctttagaaaaacagatacgaaaattgataaagaaagatgacaagatggcggcttttcatgtttttaacttttaggatgtttacttatcctatgttctagccaagaaagccacagtccatgagagtctgttaggtaacacaggccttctccccttcattttatttatttatttatttatttatttatttatttatttatttatttatttttgagacagagtctcactctgttgcccaggctggagtccagtggccgatcttggctcactgcaagctccgcctccccagttcatgtcactctcctgcctcagc

SEQ ID NO: 94947 - DNA, 505 bp, Homo sapiens
gtgcttaggcctgtaaacctagggaaaatttgctccactggcagagaagctagaagactgtggggagctggggcaaactgtatttggaatcaggagacctggctgaggcgacaggttcagcactaattattcattaattatattattcaatatttatattattctgttgaactaactagttaacctctctaacctcagtatttacagttataatgtaaaagggaagatatctatgaagactggatgaaggcataaaagtaaaagagctttctttccaaatatcagtaaatgtacgttttggtttaatataaagaaatttggcagggctcagtagctcatacccataatcccagtgctttgggaagttgatgcggtaggatcacttatggctagaagtttgagatcagcctgggcaacacagcaagacccccatctctacaaaaaaatttttttgtttttttttttttgagacagagtctcgctctgttgccaggctggagtgcaa

SEQ ID NO: 94948 - DNA, 567 bp, Homo sapiens
cgtgggtcatcgctgactctagaggatacacggcagcatcggcccagagacaaagtatgtagtaagctttaaaagtgtaagcgtgttctaggggatagtgaagtcttctcacctccccattaactggccaagtggggcccacaggagagggccctgagtgtcaagctcctcactgaatgcacactgtaagggaatctatttttagatggcattagagctcaatatgcctgagggcaaaatgaggttcagtccctcttcactgatctcagtctctctgctcagggtttcataaaattacaactcggtccaacccaggagtctcagttaggagaagaaaacgtaaggactgggtaggtttcccatgaattcagagcagaagcagggctggcccaggcttcagctcacaggcatggcatggtggagggaactgaatcaggagtcagggggtctacttttgtgggccttgggcccagggtaaatctcttctgggcttcagctccctcacctacaaagcagggtgccataactgagggtcctaaggccggtgggctgtagaaggtgagggta

SEQ ID NO: 94949 - DNA, 543 bp, Homo sapiens
tatcccacccaagctcccgcctgttacaggcccttggttgacaatgggtgatgaattgccctgtgtgggggttatggcaggggcagcaaaggtggcaggacgtgggcccgccctaagagtgctcttgcaaatgcagaggacagcctggcctgagaagcgtgggtttgggcgaggagaaggatgcaggcttcagggttgattgtgatttagagagaggagagaagaatggggtggggaccctcagaagcaaggctagttgagctggttccaagaagacctggttgacctgcattggggtctggactaactataagcctctgtagggatggctccagttttaattttccatggatacatcatgctcagtaattttgagggatatcttagctcctgttttagtagctgcagattctctggggaaggagcagaggaggttccttccctcctgcacttgatatgctctggagggaggcagacaagaaataaactagcaaacaaaagggtaagaatatgtccagtggtgataatcgccgtcatggaaat

SEQ ID NO: 94950 - DNA, 173 bp, Homo sapiens
atagtaggactgaacttctgagaggttaagcgacatggcacagattacacagaagagaaagattttgaagatcagatgaagtagttaccttggaatactgcagcctgggcaacagtgttaagactctgtctcaaatataaataaataaataaataaataaaaataaagcacga

SEQ ID NO: 94951 - DNA, 217 bp, Homo sapiens
tgagctagaatggttgctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggc

SEQ ID NO: 94952 - DNA, 681 bp, Homo sapiens
atcagctcgcttgaggccaggagttcaagaccagcctgggcaacatagcaaaactccgtctctacaaaaattagccagaagtggtggtgtgtgtgcctgtagtcttatcaggaggctggggcaagaggatcacttgagctggggaggtcacgttagagctgcagtgaactgtgacccccacacttcagcctggttgatagtgagatactgtctaaaaaaatatattagtaaaaactttataaggttgcgtttattctatttacctgctatataactaataccttgttttgattacattctaccaccttaccttgtgccttacatttttccgccacatttgtttctttttaatctcctttgcttttgcattgtttatgaaacaaactgtttatttttttctatatgtttattttgaagttttatacatttcactaacgtagttacttttcttttatacttctaataagtgattacctgaaagatcacgacatttgctaaagtttttactttacaacagtggcccagagtattttgtacgcccttgaatgttctttggatacttttcaaggatctagaaggtcaaaactattttcataataaaatgtagatggtatttgcctctttcactctcattcattcataggtataaagttaaagttttccagaagctaaacgatgtgt

SEQ ID NO: 94953 - DNA, 400 bp, Homo sapiens
ttcttcccttctacctttcctttccttcctttccttccttctcctttctctccttctctttatttctcccctttcttccttcctttctccctttattacttttccttccttcttcttccctttcttttttcttttctttctttccttccttctttctctttctcctcctctctgtctttccatttgccttcatccttttgcagcaactaagattcaaacttcataaacttttggccaggtgcagtggcctgtaataacagcactttgagaggcaaagacagaaggatcccttgaggccaggagttggagaacagcctgggcaacatagcaagatcccacttctaaaaaaagtaaataattttttttaattagccagacgtggtggcacatgtctgtggtc

SEQ ID NO: 94954 - DNA, 510 bp, Homo sapiens
gagtcaaaaagcctgagtctgagcctcagctttgctagttgtgtgatcttgggtatgtcacttaacctctttaagcttcaaaattgtcatctataacatgaggccaagaatgactggctcacagggctgttgtggggattaaaagagataagatatgtaaaagccattggtaatttataagatgctagaaatacaaagatttttattgtattcaaaatgattctatatttgttcatatctaagaatttacagatcatggtagcattgcctcctgtataagtcatttcacaaatatacatgggcaactaactgtccttagccaccaataaatcagggttaattttgtattttttgttttccttttaaagtttctctgtggctataatgatttacatgtcccactattaatctgaaggtcatatgttcagggacaagctttactgtgaaattctgtgccttgcctggttcttgtaatctgcttttgggaagctatatggaaggcttgagagt

SEQ ID NO: 94955 - DNA, 180 bp, Homo sapiens
gatgaaaatgttgtgaccagaggcttgccatttcctaactctatttgccagaggagcaatagttctgtattcgctaattttgtgttcacagagactttaaggaacatgactgttgggaataacaagaattaaaggtatttatttactttctctatatgattgtaatattatacccatact

SEQ ID NO: 94956 - DNA, 363 bp, Homo sapiens
acaactccgcagattcacagacatcctttcacttctataacttcgtgtatttgcttcgccagctcattacagatgtcctagcgcacggtgatatgctccacatttagcagctgaggacattttaggtccagcagatgtaaggtgaccgacccaaggtcacacagctagagaggggtggtgtcgagaatgcaggctgggaaggaagacgagagcactttttgtggcctaataaaacacagggcagcagagcccctgactcctcatagagatgggcagctcatctgtcatgttccttgcagaagcaaatgcttccacaaacacggatctctgcccgtgagactgctaggctatgtggggttcctc

SEQ ID NO: 94957 - DNA, 461 bp, Homo sapiens
ccataggccacactttgggttgcaaggatttagctattagttttgagagcagaaatcttagcttaaatttaggtgcctgccaacagtatgtttcatggaattctcattctggtacctaattaaaaatgtcagttgtatccagcaactgttgtattattcatgtgcatggaagttcatatctgaggaaagtacagtcaagaatgatcaacaaatatgtgtgatagatttagctaaaaagtagagataaacagtttttctcttaaatgcattcctaaaaactctctttgatcttcggctatcacacatacactgccagttgtgttggcatcttatttttacaaattgtgcaatatgtttctttaaaaattttaccagttgctaattgctgtacacaaggtcattgtgtgggctctaatagctgattgcagcctttaactagaaagtctgtttaagaggaaata

SEQ ID NO: 94958 - DNA, 322 bp, Homo sapiens
attctctctatgattaaaagcttcagaaacacgacctctggctccactcagaaagctgtctgatctcatatttgcatgatctttctcctttaacagaaagggaatttctttctgtgcagagcgtaagaaatacaaggctgagggttagaagcatgagttcccaggaagactgccaggagattagatcggatgatctctgaaatcctgtgatcttttcaaaattatgtttaatgactctaaatttgagggaattagtataaatcagccatgacaataattaattaattcaacatttattacataactgtaagctaagtggtat

SEQ ID NO: 94959 - DNA, 388 bp, Homo sapiens
ctgcttctgccacagacggaccatgcatgggaagaaactatttgagaatggctctccaaggggctggtcggccttgtctgcccactccctctacctttctttgttctgtttctttctcttcagtgttggtccattttccttttttcactgttgcgtgttagcacatcattactcttatctccatatatttggatgtttcctgcattatggtgagcttcagtaggtcttggatgagttagttgttctcattccaaaatgtaaatttctggtgtttagtaggtgctcagtaaagcttgagaaagatgaaagtgagagcccagaactagtataaaaatacggataccaccatagcatggtaattaaaggggtgattgtgaagatgaggtag

SEQ ID NO: 94960 - DNA, 149 bp, Homo sapiens
attaagagggcagggagcgattcacctcagaatagagatgggtaaaatctgataaatcagagttgtgccttttccagagtcagggaagctgggttagagagggtgagattccctcagcctgttggtgatctttgaaaagccctttgtcc

SEQ ID NO: 94961 - DNA, 459 bp, Homo sapiens
ctagcctaggcgacagagtgagactctgcctcaaaaaacaaacaaacaaataaccagatttaaagatttaaagcaccctaggacttttatcacaactcaattccagtacaatctcacgttgatgtctttgaaattctgaaccatttctgcagcaaaacgcctaattctccagagccctgagggcatccgtcaatgaaatcagctgatttataaacagaattcagtgattatgaaaacaatgcagtcataaaatgcttaaaaagcatagcattgttccaaggtttccttgtggacctgcaaacaggtactgtcatctagttccgaaacaagcgcattttttcagctttaaaaacaacacgcaaaatacaatagatccagtatgtgcatggttccctgttattgcatattctttcttccctaagtcaaatcactaatacctgtacctctggaacgatgtcc

SEQ ID NO: 94962 - DNA, 610 bp, Homo sapiens
gtaaagtatccaccaagttgaagaaacacagaatttggggctcaccatgttataagccccatgtatgtctatacgcaaaaacaacttctactgcaaactaagacagtaactctgctacctaacgagccacatatcggggcctgttccttctcttttaagccataagttcttactgtttcagcactaggtcgctcagcttcacttgcactgcaagtactaggagttttacatgtgtccacttaagggctttctgtgagcaggtctggccaaggttctcagtcagtgtcttggttaagatgctttcagccacaaggaaagaaaaaaagatcaactcagcatagtaaaacaataaagaaaatattttgacccaattgacaatccaaaatgaaagcagaccaaggtgtggttacttcagagattcagggatgttatcaaggacccaggttctttctctttttgctctgcaatccttggcatgccatgattacaaataccgtaggcaaacaaaactataactagcagaagaaaagggactgtttctttcctatgtacctctttccaaaagccaggaaactttttccagaaggtcttcccaccccatcccccgcca

SEQ ID NO: 94963 - DNA, 416 bp, Homo sapiens
gcagactcagcctccttcaggagcacccagtgctggacagttcctggatgggctctgcaggtggaggacaggctgagctggttccagctgcactggccctggttactcccaccccaccctgcctttctggggttgcagagcagaggttcccccctcccatctccagccttggcctgagacactcagccccttccactcccccagtgtcataactctcacatgggccttggcccagccccctaaacctgcaggatacccccttagtgcccctcaccaactcatcccacccagctgccttctggcttttccaggacactcataccagtgcctcctgagacctctggtggcacccctaagatctgagcatccccgaactctggagactacaggtgctaataaagcttccctgggccttt

SEQ ID NO: 94964 - DNA, 477 bp, Homo sapiens
tacaggggtgcaccactatgccaagctaatttgtaggaacagagtcttgctatgttacccaggctggtcttggaactcctggcctcaagcaatcctcctgccttagcctcccaaaatacagggattataggcatgagccacatgcctagctttataacattttctttattcatttatgtgttgatggacatttacattgttttcatatcttgtctattgtgaatattgcttcaagaaacataggagtgaagatatctcttcaatatgtgattttatgttctttggatatttaaccataggtaggattcctgaatcatatgatagttttatttttaattttttgatgaataatcatgctgttttccataatggctttaccaatttacattcccagtgacagtgtacaaggttccttttctctccatcattgataacatttgttttcttttgaatttttaataaacattaccctaacat

SEQ ID NO: 94965 - DNA, 1098 bp, Homo sapiens
aaaattagctgggtatggtggcgcatgcctgtaattccagctacttgtgaggctgaggcccgagaatcatttgaacccgggaggtggaggttgcagtgagctgagatcgcacccctgcactccagcctgggcgacaggagactctgtctcaaaaaaaaaaagaagaaagattaactgaatttaaaaaataacatattcccagaggttcactgtagggtgagcactgtgtcctgccacgtttggaatcgttttgtctttgaagaagtggagcctctcccagggctggctcggtgcccttgtctttccagcaacagcgttagttatagtcatctttgagactggcttttctttcatctctggagagagcttgattcgtcatcttattgctttgtctgaactaattttgtttagtagagcttttcaataaatagtttggattttttaaatgagtttaaaatatgctcatgtttctccaaattgctgattattcctttaggccttcgttagcccatcttaattttctcagaatctactcaaaacagatctgagtatttatacagatgtgcaagaaatttcttacattctcatggattttgagatgtagtgcttattagtcaaataatatctggaagttttcttcaacaaaataactctcgcagcacgttgagaggctgaggcaggattgaggccaggcattccagatcagcctgggcagcatagcaagaccccatctctacaaaaaaaaacccaaaactagatgggtgtggtgtgcagctacttggaaggttgaagtgggaggatcctttgagcccaggagtttgaggttacagtgagctatgattgcaccactgcatttccagcctaagccacagaatgagaccctgtctctataataaaagtttttaattagccaggtgtggtggtgcgtgcctgtagtcctagctgcttgggaggctcaggcaggaggatggctggaacccaggaggtcgaggctgcagtgagccattattgttccactgcactccagcctgggtgacagagcgagaccctgtctcaacaaacaaaacaaacaaaaaaacaaaaagaaagaactgcccc

SEQ ID NO: 94966 - DNA, 153 bp, Homo sapiens
tgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccct

SEQ ID NO: 94967 - DNA, 324 bp, Homo sapiens
cacacactccaggaaaggaaaagcaagcacagtagttaacccctgatagtttattagtcattcttgctttgtcgctttattaccacgaaactggtcagtcatggacataaacaaaacgtgcaaggataaggcaggctttcactcacataaaaactgccaagggccaaccccattgtgaatcactacagaaaatcattacaaaatcttaaaacaacaacaacaacaacaaaaacccagcactttgaatcatagtatctcttcaacagatacactacaaaactttatcagaaacactatgtgagagatgaacagagctaggaggta

SEQ ID NO: 94968 - DNA, 792 bp, Homo sapiens
agcggttggatgagaggaactagaagcagctattgcaagctaccattttgagaacctgcccaaagaaagaaaagactgaagggatagaagattgcagaaagcatgatcggagaagagatattttacttttagtgaagctctatacacatttgtcttcctcactagatttgtatccctagaacctagaacagagtcagccaaagagcaggcactcaatacaaattgttgacttgctgctaaaattgtaacagagtacaaagaacatcctagaaattggagacaaaggggataagaaaacagagttaacttggaaagagaagacactcatctctgacaagactgaagatgattacacaacaccatcattgccaaccaagtcctttgggaatacaaaggttaaatcctaatcatcacaacagtctctaaaggaataaacctgatttacagattttgataacaaaatacttctcctctttccattttctacaatgcaaccaacagcaacatcaaagaggtttttaactgaagactctatgctctgtagttctttccacaaagagctgactgatatttgaagaagtgttttcatctatccaagaaaaatatgatgtctccatcccaagcctcactcttattcttaaatgtatgtattttatttgtggagaagctgtacaaggtaactgtgtacatcattctacggactcttcagtagttaacattgttagaagatggatctcactgcaacaggactgcaaaagtaacacgtcactgatcacgttggtcacggaagac

SEQ ID NO: 94969 - DNA, 596 bp, Homo sapiens
tggcttcatggccttctagcttcatacagcagatacagtttgaattttggatttcgttaaaaagaaaacacaacactatggaaaaggtagaaaatataatgagctccttgtactcatcattcaaattcaacatgtgttaactcatgacctctttataaatgtctgtgtttttatctctccctcttcccttcatgacctccttataaatttctgtgtttttatctgtccctcttccctttgattttttttttttttttttttttactcttgcccaggctggagtgcagtggtcatggcatacagcagtttcgacctccctgggctcaggtgatgccacctcagcctcccaaatagctgggactatatatggcacatatacccaccttgtgccgtgactataatttttctcgtgagttatttgggtcagaacgaacagggggctcttgtgcccaagtgtgtgtgccccaaggcgtgtgggctcctcaaaaaacactctctggtgggctctctaagagcaagactcaccacaccaaacctgtgtgggagatcctactcaaaaaatgtgagtgtgaaaatattcacgagggcacattaga

SEQ ID NO: 94970 - DNA, 817 bp, Homo sapiens
gaaggatagacaatggttttagattattcctgtagggaaatcctttgttatactttacttcccctgcactccctgttatgattaaaaattgttaaaggtgttatcagtaatatgcagagggctgtgtagtaactagctaatttaaattacaataacacatggtgaaatatgagggctttctgcatgacagcattacacatctgataaaatgttctgaggactcagagaccacgatgtgtaaaaaaaaaggaaatagaattaagtgagggtatgttatgcataatccaattatacctgattatgttggcatctgagaactgctgttgaggtgcactgtggtttctcagctgatggtcttgctgctgggaccaccatccaggcaagggcactagcctgcttctcccaggatattccaggtgtgctcattagctagttggtgggccctcagctccaggcagcctgactccatagcctgtgctccttacctttatattacatgaggaccaaggtcagtggaaaaatcatgatgcagcccaagtaacctcagcataaattttcatgtaatttattgaatagacagtaattcacattgttaaaaaatatgcatacacaaaggccatgcagtgaaaagtctcactccttctgtccagcatcaactccccactccagataaccacgtttactagtttcttcacatgcttccagaggtttctgtatacaaatatgaaaatattaatttatgttattttcccctcttttttatacacacaatttctgggttatcctgttgctcttcttcattcatatatataatcca

SEQ ID NO: 94971 - DNA, 408 bp, Homo sapiens
aagtgacaaagggttaaatttcatgatattaatcagactttttacaccctgagctagaaaaaggaagcctaacagaaaataagcaaaagatatgactaagcaattcacagaacagcaaatcaaaataaacagcaagcatatgaaaagatactttaggctgggcacagtggctcacacctgtagtaccagcattttgggaagctgagttgggcaaattgcttgagcccaggagtttgggattacaggtatgagccaccacactggctggtttccttcattttctgaaaaggattgctgtcacaattaccctcactatgccccccacaagtttctgcagatgcttctaatcagcatgatggtgaagtgcaggtatgcatgtatagtttaatgatataacccatattacca

SEQ ID NO: 94972 - DNA, 903 bp, Homo sapiens
gcctgcaagaggacagaggctcagagatgaagggccaggagcaggccagatagatctcaaccctgtttaggatttaacaactgaaaataagctccaagccaactaggaaggaagtcagcctctttcatttaccagagtccaaccatgatcgactacaaacaaacttgaggcttgataaaatcagagggagacaaagatccgaatcactgcttgtccacacactgcacagaggctgtggccagcacagctaagctaggacaagtaaattaaaaggtagtataaggattagaaaggagtaaaattatctgcatagaaaaacccaagagcccagttgcagtagtcccagctactcaggaggagtccaagagatcagcctggccaacatattgagaccctgtctctaaaaaaagaaaagaaaaagaaaacccaagagaataagactttagcaacgtaagatcaacatacaaatgcaaccgtactccttgacagcagaggttggcaaacattttctgcaaagagcagatattttcagctttgtgagccatacagtttcttttgtaatttattaacactccagttcttgcaggaatacagccacagacatacataaatgaatgggtgtagctgtgttccaataagactttatttacaaaagcagccagcaggccagatttggcccacaggcagtagtttgggactctttttttttttttttctttgaaacagggtcttgctctgttaccctgactggtgggcagtggcatggtcatggctcgctacagcctcgacctcctgggcttcagtgatactcccacctcagcctcctgaatagctgggactacaagctcatgccaccatgctcagataattttttaattaatttttagtagggatggggtctca

SEQ ID NO: 94973 - DNA, 258 bp, Homo sapiens
tataaatattctacatgtcaagtgatatagatttgcaactaacattgaacgcatagggaatttgcaaacttatgttacagtagttggatctatgtaatgctttaaatatcatttacttttttacttaaaaaagtgcttaaaggccaggcatggtgactcacacctgtaatcctagcactttgggggaccaaggcaggtggatcacttgaagcctggagtttgagaccagcctggccaacatggcaaaacccagtctct

SEQ ID NO: 94974 - DNA, 825 bp, Homo sapiens
agcggaatatcgttctgtagcccaggctggagtgccatggcatgatctcggctcactgtaacctccatctcttgggttccagtaattctcgtgcctcagcctcctgagcagctgagcttacaggcacacaccaccacacttggctaatttttgtatttttagtagagatggggtttcaccatgtttaccagtctggtctcgaactcctggcctcaagtaatttgcccatctcagccttccaaagtgctgggattacaggtgcgagctactgcacctggctaccaaatgtttttaatctaatacttagaaagaaatacttaggagagctactttatgaatatatcatggatctatctactcacctggatattctgaccatattagctgtcctacttgcaaaattattttattcttagctaggataaactttgctacccatgaagaactgttccattttatattttctgagataattaacgtgttgttcttttctccttgcctataagcaagctctgaaacaaattttacactagtcacagcaactatattaactatactctccctttgttgccctgattttctgtttttatttctggtttattaactaaatagtatatatccctagtttaagttatttatgtacagatacattcaatcaaaaagcaatcaaatctaagtttcctataaaaattagtgcatatacattattggccttttggtgtgcttgactatcagagcaaaagtattagaattacttttccctcaaggggaaatcttaaagacttcttaaagaaaaatttaaggaaattcaggctatttgaatcc

SEQ ID NO: 94975 - DNA, 753 bp, Homo sapiens
aaaggaaaattataggtcaatatccttcatagatgcaaaacttctgaatgaataatagcaaatcaatcattaaaaatagggcctcttgacagagttggaaatgtctcaaaatataaaaatgtttaaatattagaacatctattaatatcaccatgttatcagattgaagaagtaaaacttctatcattattcagcaggtgcaagaaaataattttttgtaattcagtcatttatcataagctcttatcaaactaggaatagaagggaactttcttaacttcatatagtgggtctaccagaaacatctagccagcattatatttaatggtgaaatgctaagagtcatccctttaaaatcataaataagatgagaaagtctatcatcactgtttctatttatcatggtgctggaggtcccattcagttctgcaagacaggaagaagaaatcaaaggtataaggattagaaaggaaaaatacaactctcatttttcataggtgatacgattacaaatgaaccaaagggaatctatagacagctttttagaacctacaagagagctcagcaaggatgctggatacaaatgaatacccagaaatcaccaaattttaatattcaactacagatgattataaaacatacttttaaaatgtcatctattgtggtgacaaaagataaatctattaagaatgtgcaatggctgggtgtggtggctcatgcctataatcccttcactttggaaggccaaggtgg

SEQ ID NO: 94976 - DNA, 584 bp, Homo sapiens
ttagctgggtgtggcagcgggcatctgtaatcccagctactcaggaggctgaggcacaagaatcgcttgaacccaggaggcggaggttgcagtgagccgagatcgcgccattgcactccagcctgggcgacagagggagactctgtctccgaaaaacaaacacaaccatactcttaggaagttttaccaaagattttgtaaatatcctgtatttatttcccatgaagtgtattatttcttcaatattaccaatgcaagtgaacacgggctttccttatagtggtcatatctctgcttttgaactagcaaaatcagcatgagtgtgatttttgaatagatagatttctgtgaaatgcagcaaatcccatataagaaatcttagcagtagaatatgaaatcaaaattgcaaaaaagcagttatgtctaaatatgcagcccaaagtttttcttaatatctgtagatacaggccaggcacagtggctcacgcctgtagtcccagcactttgggaagctgagaagggtggatcacttgagcccaggagtttgagaccagtggggcaacatggtgaaaccccatctctac

SEQ ID NO: 94977 - DNA, 677 bp, Homo sapiens
aaagcatagtttatagtacacaaggtggctcgagtatccaccatgattgtatacaattccccttttatcctaggcatggtttatttatgtttattgaagggtattacaggaggcaatttatttcagaatcccttggagcctaatcaatgttgataagcatcatgacagctaaaaagaatctcttttgttccctctagtggtgaaacactgcagtccaaagggaggtttattggtggacaatctcatatttagtgtcttcgttgtttacagtaaaggcagaaatctcagggtaaagaatcttggttttaggacctctgattatgacttaaaataagaacaagaaggtctctttggtcccagcctctacgactattgtaattacagagacatagcttgttaaccttttgagtttttcttgctcctgagttctctcaaaatgtttagctaaggtcacaaattgagtcatatctgtaactttctgtctcaattaatacattttaatttaactgtaacatttagtttaattaaactgttaagtccatttaaaaatgctcatgtcattttaatccatacaggaaatcctctgtttcatattttgagtgcagcatgttttacaaacagtgtttctaagcaaattctgtaatctgaaactggtttattcttttttattcagaagg

SEQ ID NO: 94978 - DNA, 317 bp, Homo sapiens
tacatgcaggcagcgtggatgcactggacaaaggagtgagtcatgtccagggcagtacagagcaggacagtgtgagagtttatcatgctactcagaatggcatgcaatttaaaacttataaattatttttttaaagcctatggattatttacttctggaattttccattcagtatttttggactgtagtcccccacagataactgaaactttgaaaagtaaaaccacagataaccggggactagtatatctgttatcatttggttaggttgcatcagagaacttgatttatattcctggccctcccaccaattatat

SEQ ID NO: 94979 - DNA, 1052 bp, Homo sapiens
cagttgaagaaatgaaatttgtcttttcagttatcaatatatatgctaaatattagaaagatcacatttacctcatgggtaactaaagctgggttttgtggaagatcattgtaattatctgaaactgtgactcttacttccttttttttttggagtctcactctgtcacccaggctggagtgcagtggcgccatcttggctcagtgaaaccaccgcctcccgggttcaagcgattctcctgcctcagcctcctaagtagctgggattacaagcacccaccaccatacccagctaattttttatattttttgtagagacggggtttcaccatgttggccacgctggcttcgaactcctgacctcaagtgatctgcctgccttggcctcccaaagtgctaggattaaaggcacgagccacccagcccggctgtgactcttactttcaaaacacattttataatatctataatgacaatagcttctactgaatactacttatgtgctaagcatttaaactctacatatgttatcacattcaagcatcacaattaacctgcgatgaattattactcacagtttatggataaagaaactagggctcacagggcattcttcacttcttaaaggtatattaccagtaagtgacagacttaggatttgcaaccaggttgaactccaaagcctggctcattatgcaggtataaacactgccttgtcttatatttcatgtttttctttgtgtgaaaggctgttataaagtgtaaataaaactaatgaaacttaataggatgtgattattcaagagtttataggagtgatttcaaattcatttgtattgtatcttatttttacattagaaatgcaaaaaatcattttataagattaaatctattgagaaacacattaaagttcttattgaacagttttatcctatatagttatctcttttatctgtgtaaatcctaattatgtgaccattctttcttaacctcaggatttttttttcctaacttaccagcatactttgccctccccctcctgcgaaccagtca

SEQ ID NO: 94980 - DNA, 312 bp, Homo sapiens
cttacttttatgcaggttgaaatattttggggggaaggatactgatgtctacagttaactttgaaatgcatcaaaaacaggatgtgataaagcacatgtggtaatcatgttaatggtagaggctagtagtgggtatataggtatttaccgtaaaattctttcggctttgctgtgcattggaaagtttcataaaaaatcatgggaaatggtctaggcgccgtggctcactggtgaatattgtcaatttcatgtggttcccctcaatttatgttttatttggtcaaaaagatccttccaggttcccaatctgta

SEQ ID NO: 94981 - DNA, 428 bp, Homo sapiens
tataactgtcaacctctgagcatgagatcctaagaatttaatcactcctgataggagaagtaaacatagcaccagggtgacataacagtttccctgggctctccagaactcgagtgtgaatcattctctctgacctaattaatgctgttcacagggccatgactggctctgagtgaggactgggtttgggacagcaaccccatgtgtcctgtgcacccattgtgggctcagacactatgctagtgctttacattggggatcccatgcaattcccccagcactcctgggcagttggtgttactgcttgcattttttaaaatttccatttttattttaaatttaggggatacacgtgcgggtttgttacaattgtacattgtgtggtactgaggtttgggattgatcctgtcacccagatggtgagcata

SEQ ID NO: 94982 - DNA, 262 bp, Homo sapiens
caaacttaactctagatttatgttattttaaaatttagcttcctgatccccttttgggacaaaacaactttctcattatactagataccctataatcacccaggaagttcacattaattgatgactaaatatttggctaaaggtctatcatggccttccaaagtgctgggattacaggcatgagccatcacacccagcctatccttaaaatatttttaactaaaccagatttagggtaaaataaagcccaaattggtattca

SEQ ID NO: 94983 - DNA, 361 bp, Homo sapiens
agaactgcccgacactgcaccactgcagggcaggaactaggtcttcttctcggagggagaggcagtgtttccagaatttgcaggctcataaaaatcacctgggacacttgtgaaacatacagatctcaaggccttgccccagacctgatgagttagaatctccagggaaggagcttggggtattcatgccccagcaagcttgggaacacagctaggagggatctatctagagaaccacttccttatgatagagacaaggtcatttaaagtcacaatgagataccacctcacacctattgggatggctattattcaataaaacaaaatataacaattgtttctgagggtgcagtatgttgga

SEQ ID NO: 94984 - DNA, 1269 bp, Homo sapiens
gactcttcttgcctcagatatgaggccagcttcctaagagattttgcttgctatcctacagacagttttaggggccctagaatcttctcagaatgagagtatgtgcccataggttagtcagctatgaccatgcagtattcccagcccccccgccccacgcctccaccatctgcttcctctgaatataccagattggctgtacaccaggatgttccgggaatccccaggagagcaacagaatgtgatggacccaaatatgatgcctcagtaactcattccaggatgtacaaactgtaactgtcaggatgctccttatagctaattaaaattcttctagttacatctattttctattagctctttctattttcagtgacatctaaaaggccaaaataatccctgtggtaccactgggtttttttctatggttttcagataggaacgaaaaaaaaatgctctagcttttctgtgttgtatctgcgatgctaaaatggcaaacagcccctctagcacctcatagctctatctatggtactgaggtggcccaagtggcttctgtggtagcccactgcactctccatggtactgaagggatgaccatttgttttaacatctctctggggtccaaaagagtcctgtgacttagaatcacaaacttttttcgagcaggaagggactaacactataaattagtccaatccccttattttactgatgagtaaactgggaggttaagtgatttagtaaaggttgtagggttatcaatgttcagactaggcctacaatagccttgtacccttcagtcctattctaattcaccttttgtgacactattcagtaagcctggctaggctcttagtcccaggaaaggatccagaggatgagagtgggtgccctaatttgaagctacagaaatacacatattaagtggtagtggaggtcgtctagtgacccttggacaaggacactttgttaattaatcatctgctaataataatcctatagcccagattccacatgtaacaggtacctgccccttcatggagttttaccacatccactaaatgtcaaaaattaaagaagccttggacctccagagccttttctctctgctgacaggcaggttgactcctggcacagttcttttctattaaagatccttaggcaaagtaatgcttgcatctttttctttctcagtaacccatttcagttttgtgatgcctattgtaaggaagttctttatatctcaaatatcctttcttagacaaa

SEQ ID NO: 94985 - DNA, 454 bp, Homo sapiens
tggccggtgtccagcacgcgcactaggaccgcccccggcgcccacctctagtctcccgcatacccggcgggcttcgggacgcctacaaatcggttccaggtaatcgcgcgcgttcctccggcagcacatcgccaggccgcgggcgaagggctcccacctcctggctcggccaactctggcagcttgttctgcacacatgacgtaacccggcattagatcaaactttctggcaccttgaacccactggggtgggtggagggatggagaagatgggagaatcctctccactgccaggcgcgccgggcccagactgactcaggggccgaatgatttcctcgcagttgaagaggaaaataaaaacctaaagcttccgcttcccagcccccctcacttcccccagcccgtgcgctctctctgcgcgcaccgggaaaagagaagggaaaattaaaattaa

SEQ ID NO: 94986 - DNA, 330 bp, Homo sapiens
aaaaacaaaaccaaaacccctttcttggctctaccacttctttcatccatttcacacagtcccctatgcagaagcactttttgaaagagttgtctgtggacgctttcttaccttctcctcattccactccagtcaggcttccatcccgtcactccatggagactgctcttgtcaactttaccagaactttcatttggcagctgcagtggtcacttcagttgtcatcttatcctttcacgaccttggcacaatggcattcaccctccttcttgaaatgctctttcccatctcttgccactcctctggcttcactgcttcccagtctccccc

SEQ ID NO: 94987 - DNA, 421 bp, Homo sapiens
taaaaatgccatttacatacacatttatttgttctttacaacactgtgagacagctgataggatatctaattcacaggtgaggtaattgtaacttgctctaagtcataccaatgatttgcggtagatttggaatgtgagatcaaggctatcttcctatgctctttgcactacattaaatataaatttctgggagattctccataggaatgcaaaagcatgtgacatagaatagcctttgcctgtaaggtatagcctatggagtttgagaaacaacagttacgtaaagaaatataatgctatgtagtttacggcaagggccacagaaagcatgcagcttcctcagttctatatgatcacggtattaaggtaaaaaaaaattgggcttttaagaaaaaggttgcttacttctcaagatcattg

SEQ ID NO: 94988 - DNA, 447 bp, Homo sapiens
agcataacgtcctcaaggttcatctgtgttgtaacatatgacgggatttccttcctttttaaggctgaacataacgcaatgttttgattttaaaatactcatgctctttaagccagaagttccatgtctaggaatatgtccttaaaaaaacacacgctggctgggcgcggtggctgacacctgtaatcccagcactttgggaggctgaggcgggcagatcacctgaagtcaggagttcaagactagcctggccaacatggtgaaactccatctccactaaaaatacaaaaattagccagtcgtggtggtacatgcctgaagtcccagctacttgggaggctgaggcacaagaattgcttgaacccgggaggtagagcaagactccatctcagaaaaaaagcaacaacaaacaaacaaacaaaaacccacacatcaatgaggccaaag

SEQ ID NO: 94989 - DNA, 590 bp, Homo sapiens
  misc_feature (590)..(590): n is a, c, g, or t
ggaaccacatttaggggagtaaacagtaaaacaaaggagtatgacagaaattgtgagacaaggctggcctaattcagtttcacagcctgcttttgaaaccccactctctgcagggtatgtggagatcatcaaatggcagtccctgtcaaggaactacacaatcaagttcagtggttctcaactcatagaaggtcctaaaatcacataagcataagcccctgcaccagacctactgagtcaggacctctgggtggtcagtaccctgactctgtggggcccaggcacagctattttttaaaagccacaggaggccaggtgtgatggctcacgcctgtaatcccagcactttgggtgcctgaggcaagaggatcacttgagccctggagttcaagaccagtctgggcaacatagcaaaacctcatctctataaaaaaattttaaaaattagcacatgcctgtaatcccagctactcgagaggctgaggcactagaatcacttgaacccaggaggtggaggttgcagcgagctgagatcgcaccactgcactccagcctgggcgacagaaaaagactctgtctcaaaaaaaaan

SEQ ID NO: 94990 - DNA, 537 bp, Homo sapiens
ctgggtttacaggcatgaacgagtgtgcccagccacatttttcatattttcatattagcgtgggatcccacaatatagaaagcgttgtctcctactcttttaatttaacatgatgtggtagttttctatgtaatcaagagactgttcaagaactgcactttaatggtcacacaatattccaccacataaatataccttaatatgtttaaccaaactctattggtggatatttggactgtttacaatttttcacaatgaaaatgctgctataaacatccttgttcataaatctttgttctgatctctggttattttccgagcagagattcctagaagtgccactgcagggccactgggtagacacatttctaagcttcttgattcgtatcatgcagctgcctttctgagagagtccgctggcccccacaccaaccccatttgtgagcacacccaccagtcccacgcaggtctattttctctgaccttaacacatcatgtgtcatcctaacattgtatccttgcctcagtagctcccct

SEQ ID NO: 94991 - DNA, 496 bp, Homo sapiens
tgttggtacaccaaaatgtgggaggcatgggttgcaggtgactgctggaggaatgttgctccacacgtcactttctccaagttccagggttggcatgcttgttggcttgccaggtgtgtagcttgagtcacaggaccacccaatgcctcatgccacgtagcaagacaacagcagaagcagagctagaactcatacttgggcttcctactcccacctctctgcttctgttcttgctgcctactgaagtaccttcctcggctttccctgccctgttaaaaccccaccgtcactaatgaagttcaaacaaggcctggagtttagttattggtactgcaccatggtcagtttcctggttgagataatgggctctggttatgtaagatgttatcgttgggggaagctgggtgaagggtacacaggaactctctgtactatttttacaacttcttttgaatctaaaattatttcaaaataaaaaggtttctttaaaaaataa

SEQ ID NO: 94992 - DNA, 784 bp, Homo sapiens
aaatttataaatagctaatgttaacctagatctaaagcttcctattctgaaatccaaacatgaagactaagaaaaatatgtacattttgaaacaaagcagaaaaatgaaacttcaacaatgtaaaagagggtaaaatgccagtagacagccactttcagcagtttctgtttacagtgcttttgctggctaccattgttgctgtaaataatatatgtatactgtgatttctttaacattagacaatactgttaactccccattatgaaagatgaggaatctaagatacttttattactttctgtctcttgtttctcatcctctctccatttactaatttctgtaaattgtattatcattatttgggctcctctagtagttatctttaaagctctaaataatatgtgtctcaacctgtcaactttagctctccactgtataaaagtacaccattcacctgtcctcctgcctttactttgctggtatgtaacctcattatgtttataatatcagggtttgtgggcaggcttggtggcgtacacctataatcccaacactttgtgaggccaaggcaggagaatcgcttgagcccaggagtttgagaccagtcagggcaacgtaatgagaccccatctctacaaaatataaaattagttggactgtagtcccagctacttgggaggctgaggtgggaggatcacctgagcccaggaggtcaaggttgcagtaagccgtgatcatgccactgcactcaagcctgggtgatagagcaagaccctgactctc

SEQ ID NO: 94993 - DNA, 414 bp, Homo sapiens
aaatttataaatagctaatgttaacctagatctaaagcttcctattctgaaatccaaacatgaagactaagaaaaatatgtacattttgaaacaaagcagaaaaatgaaacttcaacaatgtaaaagagggtaaaatgccagtagacagccactttcagcagtttctgtttacagtgcttttgctggctaccattgttgctgtaaataatatatgtatactgtgatttctttaacattagacaatactgttaactccccatctctacaaaatataaaattagttggactgtagtcccagctacttgggaggctgaggtgggaggatcacctgagcccaggaggtcaaggttgcagtaagccgtgatcatgccactgcactcaagcctgggtgatagagcaagaccctgactctc

SEQ ID NO: 94994 - DNA, 422 bp, Homo sapiens
acaggtacaactaaaccaagagagggaattcagttggcctcagagacaacacaggcccctgcaccaggacagaaggaagtaatcgctcctttctcttttaaatgtccaataagttcagagcaccacacccccacacagtgcctcagtgggcacctgtacgtacactccatgaggtggctattcctttaatccctaccatctgctccaaaatgtttatccaacagtttgccatggtgcttgaacttctatcatttgggtgcctctttggaacaggaaatttaactctgtctggtgaccgtgcacaggatttatagctgttgagcctcaggagccatcaggaactgagcttgctttctttccttctctggccctgcccattcactttctgtccaagagtggccctaaaccagaagaaacctccc

SEQ ID NO: 94995 - DNA, 858 bp, Homo sapiens
ctctgagcatgtccgctgagacacagtattctcctgtgatctgggacccagaataacaggaaagagaaactgatagatgttttcatcagcccaaggatgtatgtatcttacttgagtgaattcaacagtcccaggaccactgtagtgctgtaggtctgtgtaaagaaatgtagtgacagcacattaacctgagatcattgataccatcttggttcagcctcagttccccagataagtgaacaaatgaacaaaaatgcacttcagaaatattgaaattccaaggcactatttcatggacagtgctgaacaagtatagtttggcctattggtatgtatagacttagatcatatttattgtcaatgggcttgaattctgatttccacttttgaaagtttatttcactatgtatcattacattttattgggaccttgtgaaaactacctgccatgaaatactggattttcacataatttagaaaaaatttagaatgttttatgcctcagaatggtcaggaacttcccatttcttcccacagcttctataaaaaaaatttaaaaggaaggaggagctgaaataggggctatggtcttttaaacttataaatctggaatttttaatatttcattttaaggccttaaaccgaaacacaagctactaatcagtctttctaaatctgaccttcattgaaagcaactcagaaattaataatttgtgctgtggcttcaagtttaaatagattgtttgaagagaaatcatatgtcagggtttgcaggattacaggatttctaacttaaacccccaagaacaatgaaaaagttgacgtacatgtcactatgaataggcaccttctgttgga

SEQ ID NO: 94996 - DNA, 537 bp, Homo sapiens
gaaaaagaaaaacagccatcaaaccaaggcagtaagtgccaggatataggagacagatgaagcttgagagacccttatccggtccatctgcgctgcctaaagaagaatttagcaatttagtgcaccaacttttacaagaagtgtccaaggaattacattatttgaaaccagaggcgaacataattatgatagccatttgtgcgtgtggttaaacacacaccatgttaaaaatcatgccactgatagaactcccacacacaaatagtgcttaatcctttttttcattaatgatttgtaaattgttgaaaaattgtatactcgatgaaggactctggcagtgctgtttttaaataaatgatgtggcactgaccatgatcttctgtaagatgataaaactgttggaacagcgacagcctgccacagatgatgtcttcatgtcgcacctgtgttgcgcgggttgctggtccctgagaagctttgctcttaggattttccactcaccctgtcacctgtcagcctcgccttgatccctcaccc

SEQ ID NO: 94997 - DNA, 389 bp, Homo sapiens
ttttttggagaggataacatttagaaaaaaatctattgactaaacaaaaatcatttgacacatgaggtcaaaccttaatttagctgtaggaatcattgtcgtatcaatgtggaagtagaaatagcactaaaagaatgttctttttctcctgaaagatgcaccctctgacccactttgtgacacatagtgaggagttcagtaactataaatgttaccgatgactcttatccttggtttaactctgggttcttctaaatgcttatgtagagtacaaattatctgctgaagagtagccaaggttgccaagtgaacagcactgaagacgtcagaagggagtgaagtttggaagtgaaacagcagcctttaaatagcccgacaacacacatcat

SEQ ID NO: 94998 - DNA, 408 bp, Homo sapiens
ttaactcctactcatctttaaagtttcaggagtggtggcttatcctggatctccacagacagacccagaccccaggcttcaggaacacctttacccccttcttagtatcacctatcagagttctaatttcagtttgcatgattattaaatatttgtctttcctgctagagtgtaaactccatgagggcaggaccctttcattgcttgactatggattcctaatgcccaagagcctggcaggggctagtgtcaatcaccagcactatttgtcccttgctatgcgtcggggccttttccaacaccatgtgggcctgctcgtgctgttctcacacaagcagccctatgcagtgagcagtattgttctcatttacagaggaggaagtgatactcagagaggacggtcaccca

SEQ ID NO: 94999 - DNA, 597 bp, Homo sapiens
aaattatattccaatattttatctaaacttaagtgtggccagcattattggtttcagagttgcctaaacaacacagaatatccttaattcagtttgtaaaagagttttgaccagtgtaaaaaagtgaagacacagtttcatgtttcaagtttaaaatggaaagttaatatcatttgagcacttatgtgttttcatgtcttctacttaatctgtatgtgaaagtaaaatatttttaacaccattatttatgccatgtaaagtgggttctcagaagcacaagcacagatatttaccttctgaagacatttttggctataaaagtgcattggatggcaaacactatttgagtcaggtgttagaaatttattagatgtattatattacatagtagaataaggtccctttctcattttgtttttcctaaaaataagaaaaaaaagaagtgtgatagtaaactgtctttgctaatgtcctgccagatgtttaacttcaaattaagcaaaaagtaggtacaatatgatgatgatcctgatgatgatgatgatgatgatgatgaagaataaatggaatcaaaatgctagctttatttgacattaa

SEQ ID NO: 95000 - DNA, 481 bp, Homo sapiens
ttccccgtgacctacaagcacttatttagctgtgccagctcctgcactgctgctaaggtcccaagaaacccagatctctcacagagccatagaagcagagggctggagtatctgtgaggacaacaaccttgtctaacttcgcgacctcattcttgagcatttctactgatgagaaactcactacccccaattgcagctcattcaactttaaaattgctgctttttgaatcactgattgtgaatattaatttaaaaaaataagtaagaaaatgttttaaatgtgctgcctctttaaaaggtctcctctttgtgcaaccaaaacccacctctctagaatacagtttgtataactgaagctataatttcataccatgagtgctgctgttagcaataataatcatgcccggattttattaacaacagaagctgttgctcgtatgaaaaaacaaacattagttctaataaacatctgcattgagtc

SEQ ID NO: 95001 - DNA, 270 bp, Homo sapiens
acacctgagagagaaaaaggggccaaactagcactatctttgttaacagaaggagagactcaatgttatcaacaaatatgaatactgcagggcaccagaaaaatttcattgctaaatttatttgaatgtccacccaccattccagaacagcattgtccaagggaagtataacaaaagccacatatctagttttacattttctagcagtcatattttaaaaataggaaaaaaaggacttggcacagtggctcatgcccataatcccaacac

SEQ ID NO: 95002 - DNA, 228 bp, Homo sapiens
gaaaagggagtaccaacatgctacaacacggatgacccgtgaaaacactgttaagtgtttaacatagtgtttaggttagtgttttcttaagtgaagaagccagtccaaaaggccacgtattaatatcactgtattgacatgaggtgtttggaagaggcacatctggagagacagaaagtagattagtggttgcttagggctggggggttagtaggatatgaggagtca

SEQ ID NO: 95003 - DNA, 486 bp, Homo sapiens
aaaaatctctgtgcctcagtttccttatctttacaaccctggataagtagtgtctcctgggaaggattgtgggaaatgaggttatgtgtgtaacaacttttgcacagtgactagtgcccagaaagggctccagatgtgcacaagaaatggtggcccttttattaagaagatatatttaggactttaaaagttaggttaaggctgagcgtggtggctcacacctataatcccagcactttgagaggctaaggcaagtggatcacgaggtcaggagattgagaccatcctggctaacacggtgaaaccccatctctactaaaaataccaaaaattagccgggtgtggtggcaggtgcctgtagtcccagctactcgagaggctgaggcaggagaattgcttgaacccaggaggtggaggttgcagtgagccgagatcatgcgagtgcactccagcctgggtgacagagtgaggctctgtctcaagaaa

SEQ ID NO: 95004 - DNA, 221 bp, Homo sapiens
ctccgcaccccagcgcaactagccatttagaatgtttttacattggctgggcgcatgggggctcatgcctgtaatcccagcattttgggaggccaaggctggaggatcatttgaggtcaggagttcgagaccagcctggccaatgtggtgaaaccccgtctctattaaaaatacaaaagttagccaggcgtgatggtgcaagcctgtaaccccagctactc

SEQ ID NO: 95005 - DNA, 489 bp, Homo sapiens
tcctggactcaagtgatccacctgcctcagttccccaaagtgctgggattacgggcatgagctactgcacctggccatgaatagcctttattataggattttatattgttccagtggagctccctaagttgctgcttttcccgccataaatgtacatttaatgctcttagatcatactcagcacaaaatgactgttagctggaaaaatgactcccactcacatagtctattatattttttaattgaagtcatacttgcagcccaacttttcaggttaaatggtgttatgcaaaatattactgtttcgatgtctgagagcagtgcaggctttgggaagaagtgcaaaggccctgtaagtgtgggcttggtgtatgtttgaagggcagcagagagtgctcaggtgctggctgggagacctctcgccttgctctgtgcgatgactgtggggcctggggcaggagcagcctctgattcacacttaaaaatgta

SEQ ID NO: 95006 - DNA, 501 bp, Homo sapiens
tttttttttcaaaattacactaataccactgtcaacaaatataataaagttcaaacaacaaatgtaataaagtttgggatttcttcgcagttattttaatttttaccatgtatcgcagagggttacaaggataatgtgttccacctgtggttatattaccaacatgatatatagttatttgtcttgatatttaactttagcagtttattttaactaatccttgatttaatttttaacctaatcagatatgagtgtcacaaatcctgctcttcaatctacaatatttttaaagagctgctttatttctatccagtcaacctttcctaattttgcctaataaaaatcctaccatctatttctcttcttcctgtcttcaaggcaattcaaaatgagtccaaatgttactgtgaccttcagcaagtcaattaacttctctaggcctcaattttatcatcagtacttaacattcaatgacccataattcatacagaaataataatc

SEQ ID NO: 95007 - DNA, 468 bp, Homo sapiens
cattcaataactactggatggatggaggcattatgaagtttgccaagtttgttaacactactaaaggtttcaatgaatgtaaaaacagtggcagatgggtggttttcttgactgtgggaaaggtaaaatagtataaagtactagcaagtataaacacaggcatacctcattttattgcattttgctttactgtactttgcagatactgcattttttacaaattaaaggtttatggcaaccctccaacaaacaagtctgttaatgccaccccaaagtcatgtgctcattttgtgtctctgtgtcacattttggtaattcctgcaatatttcaaactttgtattattattatttctgttacagtgatctgtggtcagtgatctttgatgttactattttgaccgtttgtgggcaccacaaactgtgcccatataacatcagcgaacttaataaatggtgtgtgtgttcgg

SEQ ID NO: 95008 - DNA, 336 bp, Homo sapiens
aatattacgtgaatgttgtatgaaagtttattgtggctttattcatgaattgtaacatttaccttctgctttgtagccacaattactattattatgcttatttttctttacaagtctaaatattaactgttagtcctttcacctcacaaattccaaatcaaaagtatttttttcttattaaataaagaagttggttgcctggatgatatcttcaggtatatttttcttacgtttatgtaaaatacatagaacaaaatttaccatcttaatcatttttttaaaatttatttatttattttttcgagacggagtcttgctctgtcgccaaggctggag

SEQ ID NO: 95009 - DNA, 466 bp, Homo sapiens
agtcatcctctactttcgtaccctggccatccagttctcctcttcacaaacaatattaatagttttctttgtctctttgcatgcatagacatgcaagcatacacacacacattcttctcttttacactaatggtgacatactatatacaatattgcatattttgctttttttttttttacctattctgctttagaaatatttccatattagtacatcaaaaacttccttgtttttatttatttcagataatattccattatatagatacaccataatgtatttaaccagtctccaggatatcgttattataataaatgctgcaatgagtaacattgggaaaatgtcatttaacataattataatcaattcctagaaatagaattgcgggcccaaagggaatagttttatttttaatagacataaagctaggatgggacccaaggtcctatcctaaaaccaaacctg

SEQ ID NO: 95010 - DNA, 871 bp, Homo sapiens
tctgcctctatattcacatggcattctccctgtgtgtcttgtgtctcttcttatatggacatcagccatattggattaagcacccactctactccagtatgatttcatcttaatttaactaattacatctgcaatggcccaatatcaaataaagtcacattctgaagttctgagaagaacatgattttggggagtacactactcaatccaatacaataagaaacaaaaattttctcccatgttttcttccaaaaattatgtagttttaggttttatatttaggtctatagttcactttgagttaattttggtatactgtatgaggtatggattgaagttcatcacttttcatatatatatatttgttccaggaacatttgctgaaaagatgaccctttctctaccaaattgcctccgcacttttgtcaaaaatcaattaactgtatataggtgccagtttctgtgctttctgtttcattgatttgtctgtctttatatcagtgtcactctgttttgattactatagctttgtaaatgttgaagtcaggtagtgtaagttctctaactttgttcttcatttaaaaagttgttttgctattcttggtgctttgtatttctatatgaattttagagtaagcctgtcaatttgtaaatttaaaaaaataagagattttttactggggttgaattgaacctgcagatcaattttggcgaaaattggcatgttaatatggagtcttctgatccatgaacatagtacagctttcttttttttaagtctttagtttctcttggcaatgcttacattgtatgaatcttacatattttttaatcaggtttgtctttatttcatattttatgatattgtaac

SEQ ID NO: 95011 - DNA, 349 bp, Homo sapiens
aagaaaaacatgttagcaaaaactcattttccattgtctattttaaaggaaattttgatggaatattacatgttagttgttaaaccacagaattttcacaactcaaataatatacgtatatatgtactcacaagtatatatttagatgttcaaacacacgtatcttttcaccattgatagagaaggaatataattagccaacctatcataatatattcctttctctttcagaaaaaatatttctcaatatagattgtcagctgcgcttggtggctcatgaatgtgatcccagcttcggcttgggaggccagcctgagcaatatagtgagacctcatctctacaaaaaat

SEQ ID NO: 95012 - DNA, 344 bp, Homo sapiens
tctggagactgacttcagcaacacctttccccttttagttaataatttttttaattgtaagtctttctaaattttaaatttttaaaattttttcacctcttaatcagttctgttcatctttatttctattacttacctcttccttctactgcctttctcttggattctcttaggtaacaaaaataaaaaactcttgtatcgtactaaagaggcctcataagtaattcccaccaccccaccattgcacgtgaatttctttgttttttattttagagaaagagtctcactccttcacaaacacaatgccactcacaggctggagtgcagtggcataattattgctc

SEQ ID NO: 95013 - DNA, 346 bp, Homo sapiens
gggaggcggaggttgcagtgagccgagatcatgccactgcactccagcctgatcaacagagcgagattgtctcaaacaaacaaacaaaaaatgttctgccttacagagttcttaggtataaaagagaaggtgcctctaaagctcttggcaccgtgcctggcttatagtaagtgcttggtaaacgtcagctgctgctgttgtggtgttagtatcagcattgttgctgtgagaccctgcacttcccacttagccttggaaaaataagtcttcacgttaatgccatgggctaccgcttctcttttcagggcttcttggaggagggtggagatggagagacaggggggga

SEQ ID NO: 95014 - DNA, 451 bp, Homo sapiens
aaaaaccaatgggagaaatgtaccaaaaaccctcctacataaaaatggtgccaagtgaatttcaaaatagttcttgtaagaaaacaaaccgtgtttaaattaaggaagttttaatgcctgtttcaagatccattaacagaggaggctgggcatggtagctcatgcctataatcccagtactttgagaggctgaggtgggaggatcgcttgaggtcaggacttcaagaccagcccaggcaacatggagaaatcttgtttttacagaaaaaaaaacaaaaaacaaaagaaaataagaaaattagtctgctatggtagtgcacacctgtagttccagctactcgtggaggctgaggagggggacatcacttgagcacaggagtttgaggttacactaagttatgactgcactactgtactctatagcctgagtgacagagcaagattgtgtgtc

SEQ ID NO: 95015 - DNA, 364 bp, Homo sapiens
agtcctcccgcaggactctcaccctctttagacccagacactcacagttttgtccttttccaaggatgcaagcatcagagacccccatcccctagtacattcctctgttgagggctcaggaatacaggcctccaaaatgtccccagtcaagaaggcagcagttgagacctagtcccttcctctttcagatccagaagtctgggcaccttctctctcaggaccagagaccaagcccccagcccattctccttcagacccaggagttcactcttcttgctctgcttcccaagggtcccaggggcctggacctttaactcctagctcaaggatccatgaaccaaagcccccaggacctttctttaag

SEQ ID NO: 95016 - DNA, 287 bp, Homo sapiens
atgcaggagtatgcacatgtacacacacaggttcacgagcgtgcacacatgcctccacacatgcaggtacatgcacacgcacacacacagatacacgagcacgcacacacacctccacgcacatgcacacaggtacacgagcacacacgcacgcctccaggcacacacacaggtacatgagcacacacacgcctccacgcacacacacaggtacatgagctcgcacacacacctccacgcacatgcacacaggtacaccagcacacacacgcctccacgcacacaga

SEQ ID NO: 95017 - DNA, 247 bp, Homo sapiens
catcctaaaattcatatggaatctcaaaggaccccataaaaaatatttaagaagaacaaagttgtaggtctcacacttcctgatttcaaaccttagtctaacaaaactacagtaatcaaaacagtatggtatggacatgaagacaaagagactagtggaatagaatagccagcctagcctagaaataaacccttacctatatggtcaagcaattttttttttttttgagactgagtctcactctgtt

SEQ ID NO: 95018 - DNA, 512 bp, Homo sapiens
atttccatttcaataggaggcagaagacagcctggttttctgaagtgacagaaccttcaggctggtgagggctgtgaagggtcctacatttggaggcacgagaaacctgaagttgaatttctacttacattctagccatgatattgttctcaagcaattgcctttgccaggcttgtactctgttagaactctatcattactacactctttcaaacaaacaaaaccttaccaacctgtgcaacttacttcctaaacctgttcaacacccttcccgtaccacatgacatataccaaaaggtagagactaaaaataatctgcattcattactacttgaatggcatgaattgtttatcaaggtgtttttgtggttgttgtttgtttttgtttttttttgagacagggtctgtttctcccaggccagagtgcagtggcacgaacatggctcactgcagccttgacctcccgcctaagcaatcctcccacctcagcctcctgagtagctgggactgca

SEQ ID NO: 95019 - DNA, 694 bp, Homo sapiens
gtggtgggcaagcaaaagaaaacacattgtaaatacatgtcctaatgggaacgatgatccctttcttcaaagataaagccaaaaaagaattaaggtatctaagagtcctctgatggaaccttagctcggcaacactcgggggaaactaaagagaaaaggagggaggcagaaagagagagaggaagaggtaaagagagacttacagattggcaaattcacatacacagacatcaaagtgaatagtatcacttctgaacctgaataatgttaatactgacaaagaaagctcctgggactacagtagctagctattcatcaattaacaaaaggtgggttagacctattcagttagcaaactttaacaacaaaacataccatgtaagggttagaatttacttggagcagagaaggaaagaactagaatgtgaagacagaccaggcagccttatctttaataatgtcagataaagtaagcaagtgaactaactcagcaattctcaacaaccagaaagaagtcatggataaggcagaaaggagataagatggtggcattccctgtataaatgaagccactgatcatccctcaggaaatgaggtagggtacacttttcctgtcagacactgacaaatccaggacctcatcctgaaattcaataaattccttagaaattcctagaaccattaacaactgaat

SEQ ID NO: 95020 - DNA, 608 bp, Homo sapiens
tggccggaaggatgtcagctccaacagaacctccccactgtccagtaggatgtcagccccaacagaacccctactctggccagaaggatgtcagccccaacagaacctcccctctggctggaaggatgtcagccccagtggaacctcccctctggctggaaggatgtcagccccaatagaacctcccctctgcccagagacattccaacactgccataaacttctcccctacacaaaaacattccaagcttgtgataagccccctcaccctaaaaccaatatgtactcttagtctgtaagacagaatgctcctgactgaaattggccagaagcccgtgatccggtagttcatctgaaaactcatttaactgaatgctccaagggatgaccaagctgctacaacgctgcttcttccccttcaagtctagggatggtaacagcttcctgctgttgctagaccctgtatgcatcactacttattggttctcttaacctccccacacctctataagttgtcccttgtagccatctccaagccctagccgagtacacccttcatttcctgccagggtgctgactgcacattctctgcaagtccacgctcaact

SEQ ID NO: 95021 - DNA, 277 bp, Homo sapiens
agagacggggtttcaccatattggccaggctggtcctgaactcctgaactcgtgatccatccgctttggtctcccaaagtgttggcattacaggcgtgagccaccacacctgaccaatggtgctgatcattgctacacctcattaataatgctacaaattggtctggttgatagttgaaattacaatgctttggttgttttatatcttaaactgaaaaagggtcatttatttcaaagatattgctaaagcctaactagctattaaactatatttaat

SEQ ID NO: 95022 - DNA, 287 bp, Homo sapiens
agtctgcatttatttgggtgttttgcaagatgaagcaggaataaggtggccctggctacgtgtttgctgcttttcattttggggactgtgggtgagcaacaatagaactgtgtatatggtgattctggttatttttgaaaaaaggtcaacactggtattttactagaatactccaaaaagttaaaatatggagcactcaagaaggacttcctataaaaattttcacttatcacaattgtgctgttagtcgttcacagtattttaatagttttttgttgttgttgttg

SEQ ID NO: 95023 - DNA, 442 bp, Homo sapiens
agggagctactgaagattgaaagtagaagagtgattcggacttggtcagatttgtgttttggagggctcactttcacagctgtgaggagtggatatgagggggaaaggactgaagacggggtggccaccaagaaaactgttattcaggtaacagaggaagcaggtctgactaggacaggagaacttgattgtacaagcatcagcctggcagatgccaccaggccaactgagcccctgacaatagcaaagaacccctttctgataaataagaaaagtggctgccctcatggaagactcttgataagtacttcattgatttattggctttatatcattttgtcccaaacaagtacttacgggcacaaaggaagaaagaagagccaagaaaaaaaaatggaagatacacacaagataaacaaatgagtgaagaaatgatattttg

SEQ ID NO: 95024 - DNA, 208 bp, Homo sapiens
aaacttgaaacccacagacattgctggtaaaaatgtaacatggtttagctgctatagaaagaagtctgatagttactcaaaatgttaaacatagattatcgtatgactcagcatttccactcctaggtgtatggagtggaaatgaaaatgtgtatgcacacaaaaacttgtacatgaatgtttatagtattgttattcataataacca

SEQ ID NO: 95025 - DNA, 808 bp, Homo sapiens
ttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatcatgcagctgctgatgaaggggaaccggcagaggacccaggagcccacggcgccaaccagacgtcctcccgctcccacgcggtactgcaggtgaccgtgcgccagcgcagccgggtcaagaacatcttgcaggaggtgcggaaggccgcctgttcatgatcgacctggctggctcagagcgcgcctcgaaaacacagaatcgtgggcagcgtattgaaggagg

SEQ ID NO: 95026 - DNA, 733 bp, Homo sapiens
aaggctgtcctggtctcgggcgttatggatagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatcatgcagctgctgatgaaggggaaccggcagaggacccaggagcccacggcgccaaccagacgtcctcccgctcccacgcggtactgcaggtgaccgtgcgccagcgcagccgggtcaagaacatcttgcaggaggtgcggaaggccgcctgttcatgatcgacctggctggctcagagcgcgcctcgaaaacacagaatcgtgggcagcgtattgaaggagg

SEQ ID NO: 95027 - DNA, 724 bp, Homo sapiens
ttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatctacaatgagatgatccgggacctgctgaacccctccctgggctacctggagctgcgggaggactctaagggggtgatccaggtggccggcatcaccgaagtctccaccatcaatgccaaggaggcgagttttgtgtgg

SEQ ID NO: 95028 - DNA, 614 bp, Homo sapiens
agcggctgtcttacagctgatccggttcttgcggcggtgcgtgctggcgccggagagttccgcgcgtgtcctcgggctgtccgcggggaagctggtccgggagtgggcgcccgcccgcctgccttgcgccttgcgcccccggcaccgcttccagaagggaaagtcgccgccgctcgcggtagacccgggcagcgcttccattccgcggagctggaaatagggatccagccatccgtgggtcaggaggaatggagactgtaccttccacatagattcacaagctgccatgcagtggccttggcttcagcgaaaggagcattcagacgcttccgtcagcctcccaggatggcagcccctgacctggcccacggaggtcatgcttctagggactcagtctgccttcatgaagaacagacacaggcagcaggatggtggctggctggcctgataaacttgttaccaggacgcggtgacctttgacgacgtggctgtggacttcacccaggaggaatggactttactggaccccatctcagagagacctctacagagatgtgatgctggaaaactacgagaacctggcctcagctaggacatcacctgttccaacccag

SEQ ID NO: 95029 - DNA, 174 bp, Homo sapiens
atattacacacagtgagactgagctctagggagaggcagaaccagaggcagaatccaggtttccacacctctggtctctaacactatcctcaaaactagccctttccaacctgttgcactagggttcacctaaaagaaaatgccaagatatcattatcacaggctttcaagagc

SEQ ID NO: 95030 - DNA, 132 bp, Homo sapiens
ggaaaacgagaaccctagctctcctttacaggtaaccctggccactccacagttcagtcattaaaaatgaatctgggccgggcacagtggctcacacctgtaatcccagcactttgggaggctaaggcagcg

SEQ ID NO: 95031 - DNA, 229 bp, Homo sapiens
aatcaccatcccattcccaagttaactcggatgttggacagattctcaaagaagtaatatcgtaaagatacagtcagttccagggacagcatagaaggtaaggggtggtttgaagcatccttgtcagccagaacttgggtctgtcccaacttttttgtcttaatatatctggacactactccttccctcaaactcacccactgcccacccccacctctgcttcccactc

SEQ ID NO: 95032 - DNA, 272 bp, Homo sapiens
agtagccctttcccccaggaagatgcatattgtaggcagaatgatagccctccaaagatgtctataccctcatgccccaaatctgtgaatatattacattacatgacaaaggacagttcagattgcagatggaattgaggtttcttatcagctgaccttaaaacagggagatcatcttggatcatctacacagattcagtgtaatcacaagggtccttaaatgtgcaagagggaagcagaagagtcagagcgatatgaggtgaaaaagactt

SEQ ID NO: 95033 - DNA, 464 bp, Homo sapiens
gggaaggtctctatgaagcacaaggatccagccgaaacaaggagtcagcttggcgaagagcgaagggaagagtgtctcaaacagggtgcagcaacggccaaggtccatgggtgggactgatccaggcttgtttgaggactgaaaaaggcagtgaggggaccagagcaaagtgatggaagatgaggtcagagaggtgggcagggatcatataggctcatgtagagcctcgagggccatactatgcaatctggatttcattccaagtgcagtgggaggacaggaaggttttgagtgagtgagtgacatgatttatgctttaagaaattactttagctgttctgtggaaaatgaattgcagaagggtgggaacagaagcaggagagcagctggaatctactgcagttgtccatgtaatggatggccccagagcttggacggtggcagtagggacagacggaagagca

SEQ ID NO: 95034 - DNA, 415 bp, Homo sapiens
ccattccttttcagacttagctttgggaggcagtgtgtcagcctggagtgcgggcgagtacttgaaagccttaagttctgtcttatgttgggttccctagaaggagagcttgagataggaattctgtgaaagtgattgatttgagttgtgactcatgcatccccgagagagggagacaggataatagggcaggggaggggacatttggcctcagtctgatcccctggggcactctgaagccacagagtaagtcctgccttggggcaagggtaagtagcccctcgtgtcccttggaagccagtcattggctgtgggagtgagggatttaccaggaggggtggagactgtagggcagcatgttggaggacagccctcctggaaaagggtgtaactgtaaactgagcagacaactgtc

SEQ ID NO: 95035 - DNA, 417 bp, Homo sapiens
taaattcatgcttacctcactattttagaactgaaacctaaaaatctgcttgcttccatttatggaaatgtttacaaacatcaggtttcctggttctggaaacaaactctgcaaagcctacatcttcataacggttagagaagaaatgcagaatccagtgctggtgaacagctttcccccatatctacccctggttaatatccatgatgtttagacatatatttttggtctaaggacaatgagcatggatttgttgtcctataacttgatatcccaaggaaaagaggggggaaggatgacatagctccaggcacaactattggaagaaaggatttgtattaggatgcggggtctgagaacactgtgggaagcaggctggcagtgtgcatatgcatgtgcatgtgtgtgtgtgtgtgc

SEQ ID NO: 95036 - DNA, 554 bp, Homo sapiens
ctctacaggagtatgattgggagaggttgagaagctgtcatagtgtccctgatgtgggagggcacaagcaaaggcccaggggcaaggaactgtccagtagattccagaagagagctaccattgcatacagcagagtgtacaataacagggtagtcagtacactgcatcaaggggctgaaggcaactgccttttggtttgagcatagtctgaaagcagtggagccactgaatcccacaaaagctggtaacctggacagctcaaaagtcacagccatcaggactttgcctggaatattctggcattattggcaaacatctatcttcccctaacaggttggctgctgtatactgagacccagtcggagatcagaaggcaggttcagtagaaacacgtaggactctactcatgtattaggcatgcattattattccatttgtttatttatactattaattagatagtagactttattcagatttctgtgtttcctttttttaaatagtcgagtttaccgaagttcttagaaactggatgattgcctccaataatgtgg

SEQ ID NO: 95037 - DNA, 485 bp, Homo sapiens
gtcagctgcatcatgggtgactcgtataggacccgtgcataatagagactggtgaagtgcggtgctgagatctgtcccgtcgttcaatcaaagtcgtgacgtgaaaagcagtgtagcagagactactcatagccaacctgatcacgattccccctgcttcctggttttccaggagttgacaatgtgcccaggctccaccgcagccagcagcagccagaggatacagttaaggccaaggtgatgtaagcagaagccatttgaggggagtttcccgagagcctttttagcactgtctgtccttagactctgctctgggcctcctgctttagagggcctcactcgaatgtctctctctctctctctctctctctctctctctctctcacacacacacacacacacacacacacacacacacacacagacacacacagagctatggtttgaatgtgtaccccaaagttcatgtgttggaagcttaatcc

SEQ ID NO: 95038 - DNA, 470 bp, Homo sapiens
gatacagtttcagggccgggcatggtggctcacgcctgtaatcccagcactttgggaggctgaggcgggcggatcacctgaggtcgggaagctcaagcaaactgcctgcctcccaaagtgctggcattacaggtgtaaggcactgtacccggcctgtccttcccctttgataacctggttctctctgatcactcactcaaatatatacacataaatccttctgacacaaaaacattctctccattcccattcttttataaaagtatcaagtgttgagacctccagttacaactctgttttacgaagcttcccaacacctgtccagtaactctaatgcaacacctcgagggcccagcctgccaggatctggagctctggtcttcacccccaagactctggaatccgggaatatgtccttccctagaacatgtgtctcactgactttagggaaataagaaccgcctggtact

SEQ ID NO: 95039 - DNA, 344 bp, Homo sapiens
ctacttgactgggtgcccagatatttggtcaaacattattacagatttgtctgtgaagtgttttggggtaagattaatatttgaattggtagatggaataacacagattgtcctccataatatgaatggccctcatccaatcagttgaaggcctgaatagaacaaaaaatctgagtaagctggaactgcccctgcctgactgctttgagctgggactttgatcttttcctgctttgggacatgaactaaaacatcggctcttgggtttttaccctgccagctttcggactcgaatgttcaccattgacttccctggttctcaggactttggacttaggctggaa

SEQ ID NO: 95040 - DNA, 179 bp, Homo sapiens
accttttccccctggctacagttttggtgggatgggcagttcaggtgtcctgccaacgagatactcttctcctggaatttgaattttgagtcatgggatacaaggactgacagtgattggcactgattcagcctggccgaggtgctctgaagaagccactcattagttcctgcctccca

SEQ ID NO: 95041 - DNA, 516 bp, Homo sapiens
agaggaaatataaaacagttgcttttagaaaacagtctgtccgtttctcaaaatgtcacacataccattaccatagaatccagaaattctactcctaggtgtatacccaggagaaatgaaaacagacctccatgtaaaaaaaatgaatgcaaatgtttatagcagcatggcagaattattcatggtaggcagaatgtggatgcaacccaacatctatcaactggtgaatgaagaaagaaaatgtggtatagtcatacttggaatattaatctgcaataaaaagaaaggaagtactgatgcatgctgttccatggataaaccttgaaaacgtcctataatatggatgaaccttgaaaacattatgctaaaagaagccagtccaaaaggccacatattatatgattccatttatatgaaatgttccagatcaatggagctagaaggtctattagtgtttgcctgaagctgctgaggggaaggtggagaatggagaatgacagctaatgggtaatcgaa

SEQ ID NO: 95042 - DNA, 709 bp, Homo sapiens
aggctggagtgcagtggtaccatcacagctcactgcagcctcaacctcctgggctctagtgatcctctcactttagcctcctgagtagttgggactagaggtgtgcaccccatgcctgaaaaacattttaattttgtgtagagacagagtattactatattgcccaggctggtcttgaactcctggactcaagcaatcctctcacctcagcctccccaagtgctgagattacagatatgagccaccatgcccagcatttttggaaggataaaatgagattggacaggtattatgaagcctattttacagatggaaaagctactactcataaatcttcctgaaatttgttcaagttagtcttttccaaacctcacatttctgactaaatgctagatattccgattcctcattaactgctcaatagttgatatttaagggccgggcttggtggctcaggcctataatcccagcactttgggaggctgaggcgggcggatcatgagctcagcagatcgagaccatcctggctaacatggtgaaaccccgtctctactaaaactacaaaaaattagctgggtgtggtggtgggcgcctgtagtcccagctactcaggaggctgaggcaggagattggcgtgaacctgggaggcagagcttgcagtgagcggagatcgtgccacagcctgggcgacagagcaagactccatctc

SEQ ID NO: 95043 - DNA, 586 bp, Homo sapiens
tccacccacccagacagacaccgaactggaaatacacccctaacctctaccccagataacctgacaagctgatcccctgcccacacacccagcaggtggctccaaggtcagagcctgcagaacacagatgcaatagagaaagactcagcgctgtggaaagacacccccacctccccacgacagtggccacagggccacccccaaccgcatgaacgggtgatgcggttgcatgctttttgttcactactcttgtacctgtgttgttacagaggcagataagcgactgaggactggcatgaggttctcagtagtgagatttctgtaggagtccatattgagtgtgttgttcccttcacttcccaagagaagtgaagatcagggactctagtaccattgtgtattttgcagtttcattgagactataattcgcataccataaaagtcatccagccgaagtgtacatttcagtggattttagtacatcacaaggtgtgggaccatcaccactcattgacatgaaaaggaaaccggtgcccaccagcagtgacgtccacatgtccccttcccctcggccccaaccgcatca

SEQ ID NO: 95044 - DNA, 390 bp, Homo sapiens
ctaacttgaacagtcaaggaatttattggaaggatattgggtagtttgagaattgaaatgaggctggtgaactatgctcagaaaataaccacaacaagaggtcagggagcggctgccaaagccaaggtcacccctcagaattggtctggtaacgatgctgccaggcacagctgcccctgaacatgcaatgccaaagccccagatcttgcacaacacagcagccagtggactctcatccttggtggcgcagctgttctgtgtactctcacctgctctcatctgtgtctttgcatcactcgtcatgattccaagtcccagaaggaatatctcgttagctgggctgggttagatgtctgagaccaagtgtggttggcaggtgggggtgtggga

SEQ ID NO: 95045 - DNA, 1506 bp, Homo sapiens
gtgtgatccttttgcgctcgttgccctgccggggccgtccgcatcgggcccccgctgttccgcttggccacagtggaccttcacttgtgctcgtgatgtgccacatctgctcccaccgggcatctgggtgtctcagctttattcgcgggtccgtggttcatgtgctcgggctccggcgccttgccgtcagaggctgccagcgcttccctccgcttcggtctgctgcgactctgctgccccccgcccggcaccagcggggccccgcgtgccccgtcagcctcagccgcctctcgctgggccctggcggctctggccacgtccaggggtcttccgcagcctgagcggcggggccgcctggggcgccgtggagtgcgactctggtacccctggagagcccgccctgctatgaggactgccctctagcttcccggtgctcattgtccacggatgacagcgcgctgccaggggtgatcgggcacggttgctctctgagacctccctcactggcccccagtagtggccccctccccaccattccaccatgggcttagatgcccgagtgattgttgtccaaaacaggcgggaaaacagaccagccacacacaaggggcaggggtgagggtgggggtgggggtccttaaacagactaaaatgcagttacctgtggtcattttggaggaagtggaagcctaagaatcgcccccagcatggcttcatcccccaagatggccgatgatctggcctgaaggcctctcacaaagggcaggagaagaagcttccagaaaggctgggatggaggaggagtcctgcggccagctgttgcctgcagcagaggctgcctgtggacacttccctaccggggctgaggccatgctgggagccccccccagtgacgcagaagcacaaattggaggcttggggccatgcccagccaggttggcttccctggggctgaagagctggctgtggtggcaccatggccttggccctgctactcacccaacattcccatcctcccctgataggcccctcctccttgcctgccctctctcccgctgctcagggccagtcactccccccacatgcagctacccctacaacctggggttccttctcagggcctcacctggtccccacatcccctggcctctgctcctgcctcccaaagtccatgtctgcctccatcagccacacacacgcagggacgcccgttccttgccctcccggacttatctactcttcactttcctgatgatccatggggcccaggcctagagggcatccgaggggctgggccttggccacagcctcttggatgatgtccttgctccaccacgcaggcccttgcttctcccatcaacgagtcttggcccaggggacactgaccctcccccagggaggagagaggagttccttccctttcaacgagggcttccacgccctctaaggggtggcggggaagggaggaggctgagaagatgcagattaaataaaggtatggaatgg

SEQ ID NO: 95046 - DNA, 1794 bp, Homo sapiens
gtgtgatccttttgcgctcgttgccctgccggggccgtccgcatcgggcccccgctgttccgcttggccacagtggaccttcacttgtgctcgtgatgtgccacatctgctcccaccgggcatctgggtgtctcagctttattcgcgggtccgtggttcatgtgctcgggctccggcgccttgccgtcagaggctgccagcgcttccctccgcttcggtctgctgcgactctgctgccccccgcccggcaccagcggggccccgcgtgccccgtcagcctcagccgcctctcgctgggccctggcggctctggccacgtccaggggtcttccgcagcctgagcggcggggccgcctggggcgccgtggagtgcgactctggtacccctggagagcccgccctgctatgaggactgccctctagcttcccggtgctcattgtccacggatgacagcgcgctgccaggggtgatcgggcacggttgctctctgagacctccctcactggcccccagtagtggccccctccccaccattccaccatgggcttagatgcccgagtgattgttgtccaaaacaggcgggaaaacagaccagccacacacaaggggcaggggtgagggtgggggtgggggtccttaaacagactaaaatgcagttacctgtggtcattttggaggaagtggaagcctaagaatcgcccccagcatggcttcatcccccaagatggccgatgatctggcctgaaggcctctcacaaagggcaggagaagaagcttccagaaaggctgggatggaggaggagtcctgcggccagctgttgcctgcagcagaggctgcctgtggacacttccctaccggggctgaggccatgctgggagccccccccagtgacgcagaagcacaaattggaggcttggggccatgcccagccaggttggcttccctggggctgaagagctggctgtggtggcaccatggccttggccctgctactcacccaacattcccatcctcccctgataggcccctcctccttgcctgccctctctcccgctgctcagggccagtcactccccccacatgcagctacccctacaacctggggttccttctcagggcctcacctggtccccacatcccctggcctctgctcctgcctcccaaagtccatgtctgcctccatcagccacacacacgcagggacgcccgttccttgccctcccggacttatctactcttcactttcctgatgatccatggggcccaggcctagagggcatccgaggggctgggccttggccacagcctcttggatgatgtccttgctccaccacgcaggcccttgcttctcccatcaacgagtcttggcccaggggacactgaccctcccccagggaggagagaggagttccttccctttcaacgagggcttccacgccctctaaggggtggcggggaagggaggaggctgagaagatgcagattaaataaaggtatggaatggaaggcctgtgcattcctggggcatgggtctaaggcctccactgcaagcattatgggcccccatggttcagggcacgatgaggggttctgggaagggactcagaattgggctccagtgttcccaggaaccaagtaagcagaggagaggaaacctcccctgcctagcctggggcctctgagactcaagtgtgaggcgctctgagcacctggctcccctgactccggtatctgggcctgggtcactgctaaggcattgtcaaggtggcccttgttccagctcagtgggaca

SEQ ID NO: 95047 - DNA, 1052 bp, Homo sapiens
attatcacggtgaactgcagctcggagggaggggtcaatataaaccacggacttgcaggtgtagaagtcacatgggactcatagagggtgcaaagtagaagattggagtcagagagggattcagatgatcaaagagaagttggggtgctccacccgacggggtgagggtgggggtgggggtccttaaacagactaaaatgcagttacctgtggtcattttggaggaagtggaagcctaagaatcgcccccagcatggcttcatcccccaagatggccgatgatctggcctgaaggcctctcacaaagggcaggagaagaagcttccagaaaggctgggatggaggaggagtcctgcggccagctgttgcctgcagcagaggctgcctgtggacacttccctaccggggctgaggccatgctgggagccccccccagtgacgcagaagcacaaattggaggcttggggccatgcccagccaggttggcttccctggggctgaagagctggctgtggtggcaccatggccttggccctgctactcacccaacattcccatcctcccctgataggcccctcctccttgcctgccctctctcccgctgctcagggccagtcactccccccacatgcagctacccctacaacctggggttccttctcagggcctcacctggtccccacatcccctggcctctgctcctgcctcccaaagtccatgtctgcctccatcagccacacacacgcagggacgcccgttccttgccctcccggacttatctactcttcactttcctgatgatccatggggcccaggcctagagggcatccgaggggctgggccttggccacagcctcttggatgatgtccttgctccaccacgcaggcccttgcttctcccatcaacgagtcttggcccaggggacactgaccctcccccagggaggagagaggagttccttccctttcaacgagggcttccacgccctctaaggggtggcggggaagggaggaggctgagaagatgcagattaaataaaggtatggaatgg

SEQ ID NO: 95048 - DNA, 722 bp, Homo sapiens
gggggagggatagcattaggagaaatacctaatgtagatgatgggttgatgggtgcagcaaaccaccatggcatgtgtatacctatgtaacaaacctgcacattctgcacatgtatcccagaacgtaaagtatagtaaaaacaaacaaacaaaataacaaaacataaatatctacaacattgtattttgactggcagaatggattagaaaatatgaactgcgtatatgctttctacaagaaactcacttcaagtataataataggcaagttgaaaataaaagaatgaaaaaagatatatgatgtaataattaaccaaaagaaagtaggagtggctatattgatatcacataaagcatacttcagagcaaagaaaagtaccagagtcaaggagagatattatgtaataatatagggtcagtccaccaaaaagacacagcaattgtaaatgtgtctgcaccaaataacagctgcaaactagtgaaacaggaaaagttccgttgtccccctctcaggtcatgcaatgtgggtgtggcttgcttcttcattccctgctgatcaaacctctagaggagcatacaaatgggcaagctgtgggcctccgaccccatggcagtgtctaggggtgaatgtttatagctgaacccccagtgggcatgtgttacagggtgcttttttagtttagccatccataggtggcttgtattagctcaattaggctcct
